US011225508B1

(12) United States Patent
Baric et al.

(10) Patent No.: US 11,225,508 B1
(45) Date of Patent: Jan. 18, 2022

(54) MOUSE-ADAPTED SARS-COV-2 VIRUSES AND METHODS OF USE THEREOF

(71) Applicant: THE UNIVERSITY OF NORTH CAROLINA AT CHAPEL HILL, Chapel Hill, NC (US)

(72) Inventors: Ralph Baric, Haw River, NC (US); Kenneth Harold Dinnon, III, Chapel Hill, NC (US); Sarah Rebecca Leist, Carrboro, NC (US)

(73) Assignee: The University of North Carolina at Chapel Hill, Chapel Hill, NC (US)

( * ) Notice: Subject to any disclaimer, the term of this patent is extended or adjusted under 35 U.S.C. 154(b) by 0 days.

(21) Appl. No.: 17/173,617

(22) Filed: Feb. 11, 2021

Related U.S. Application Data

(60) Provisional application No. 63/081,943, filed on Sep. 23, 2020.

(51) Int. Cl.
| | |
|---|---|
| *A61K 39/215* | (2006.01) |
| *C07K 14/005* | (2006.01) |
| *C12N 7/00* | (2006.01) |
| *A61P 31/14* | (2006.01) |
| *G01N 33/569* | (2006.01) |
| *A61K 39/00* | (2006.01) |

(52) U.S. Cl.
CPC .......... *C07K 14/005* (2013.01); *A61K 39/215* (2013.01); *A61P 31/14* (2018.01); *C12N 7/00* (2013.01); *G01N 33/56983* (2013.01); *A61K 2039/5258* (2013.01); *A61K 2039/53* (2013.01); *C12N 2770/18022* (2013.01); *C12N 2770/18023* (2013.01); *C12N 2770/18034* (2013.01); *C12N 2770/18071* (2013.01)

(58) Field of Classification Search
None
See application file for complete search history.

(56) References Cited

U.S. PATENT DOCUMENTS

| | | | |
|---|---|---|---|
| 3,610,795 | A | 10/1971 | Antoine |
| 4,474,893 | A | 10/1984 | Reading |
| 4,501,729 | A | 2/1985 | Boucher et al. |
| 4,676,980 | A | 6/1987 | Segal et al. |
| 4,816,567 | A | 3/1989 | Cabilly et al. |
| 5,879,881 | A | 3/1999 | Rubenstein |
| 7,201,898 | B2 | 4/2007 | Monahan et al. |
| 2003/0073147 | A1 | 4/2003 | Alderete et al. |

FOREIGN PATENT DOCUMENTS

| | | | |
|---|---|---|---|
| WO | 9400153 | A1 | 1/1994 |
| WO | 9517210 | A1 | 6/1995 |
| WO | 9633739 | A1 | 10/1996 |
| WO | 0191803 | A2 | 12/2001 |

OTHER PUBLICATIONS

Dinnon III, et al. Nature vol. 586, pp. 560-566 (Year: 2020).*
Genbank MT461671 (Year: 2020).*
Pokhrel et al. ((2021) PLoS ONE 16(5): e0251426) (Year: 2021).*
Chen et al. "Boosting with recombinant vaccinia increases HPV-16 E7-specific T cell precursor frequencies of HPV-16 E7-expressing DNA vaccines" Vaccine, 18(19):2015-2022 (2000) (Abstract only).
Dinnon et al. "A mouse-adapted model of SARS-CoV-2 to test COVID-19 countermeasures" Nature, 586(7830):560-566 (2020).
GenBank Accession No. MT020880 "Severe acute respiratory syndrome coronavirus 2 isolate SARS-CoV-2/human/USA/WA-CDC-WA1-A12/2020, complete genome" NCBI, 11 pages (Mar. 1, 2021).
GenBank Accession No. MT461671 "Synthetic construct clone icSARS-CoV-2-nLuc-GFP ORF1ab polyprotein (ORF1ab), ORF1a polyprotein (ORF1ab), surface glycoprotein (S), ORF3a protein (ORF3a), envelope protein (E), membrane glycoprotein (M), ORF6 protein (ORF6), ORF7a-GFP-NL fusion protein (ORF7a), . . . " NCBI, 13 pages (May 13, 2020).
GenBank Accession No. MT844089 "Mutant Severe acute respiratory syndrome coronavirus 2 clone SARS-CoV-2_Nluc, complete sequence" NCBI, 13 pages (Sep. 7, 2020).
Gonzalo et al. "Enhanced CD8+ T cell response to HIV-1 env by combined immunization with influenza and vaccinia virus recombinants" Vaccine, 17:887-892 (1999).
Hanke et al. "Enhancement of MHC class I-restricted peptide-specific T cell induction by a DNA prime/MVA boost vaccination regime" Vaccine, 16:439-445 (1998) (Abstract only).
Hou et al. "SARS-CoV-2 Reverse Genetics Reveals a Variable Infection Gradient in the Respiratory Tract" Cell, 182(2):429-446 (2020).
Karlin et al. "Applications and statistics for multiple high-scoring segments in molecular sequences" Proceedings of the National Academy of Sciences USA, 90(12):5873-5877 (1993).
Leist et al. "A Mouse-Adapted SARS-CoV-2 Induces Acute Lung Injury and Mortality in Standard Laboratory Mice" Cell, 183(4):1070-1085 (2020).
Maddox et al. "Elevated serum levels in human pregnancy of a molecule immunochemically similar to eosinophil granule major basic protein" The Journal of Experimental Medicine, 158:1211-1226 (1993).
Needleman et al. "A general method applicable to the search for similarities in the amino acid sequence of two proteins" Journal of Molecular Biology, 48(3):443-453 (1970).
Pancholi et al. "DNA Prime-Canarypox Boost with Polycistronic Hepatitis C Virus (HCV) Genes Generates Potent Immune Responses to HCV Structural and Nonstructural Proteins" The Journal of Infectious Diseases, 182:18-27 (2000).

* cited by examiner

*Primary Examiner* — Shanon A. Foley
*Assistant Examiner* — Myron G Hill
(74) *Attorney, Agent, or Firm* — Myers Bigel, P.A.

(57) ABSTRACT

This invention relates to SARS-CoV-2 viruses adapted with nanoluciferase reporter molecules and mouse-adapted SARS-CoV-2 viruses, compositions including the same and methods of use thereof.

22 Claims, 20 Drawing Sheets
Specification includes a Sequence Listing.

Growth Curve

FIG. 1C

SARS-CoV-2 RNA

| Mutation | Gene | Coding Change |
|---|---|---|
| C9438U | nsp4 | T285I |
| A11847G | nsp7 | K2R |
| A12159G | nsp8 | E23G |
| C23039A | Spike | Q493K |
| U27221C | ORF6 | F7S |

MOUSE-ADAPTED SARS-COV-2 VIRUSES AND METHODS OF USE THEREOF

STATEMENT OF PRIORITY

This application claims the benefit, under 35 U.S.C. § 119(e), of U.S. Provisional Application No. 63/081,943, filed on Sep. 23, 2020, the entire contents of which are incorporated by reference herein.

STATEMENT OF GOVERNMENT SUPPORT

This invention was made with government support under Grant Numbers AI132178, AI142759, AI100625, AI108197 A1089728, A1014964 and HHSN272201700036I awarded by the National Institutes of Health. The government has certain rights in the invention.

STATEMENT REGARDING ELECTRONIC FILING OF A SEQUENCE LISTING

A Sequence Listing in ASCII text format, submitted under 37 C.F.R. § 1.821, entitled 5470-895_ST25.txt, 1,351,065 bytes in size, generated on Feb. 8, 2021 and filed via EFS-Web, is provided in lieu of a paper copy. This Sequence Listing is hereby incorporated herein by reference into the specification for its disclosures.

FIELD OF THE INVENTION

This invention relates to SARS-CoV-2 viruses adapted with nanoluciferase reporter molecules and mouse-adapted SARS-CoV-2 viruses, compositions including the same and methods of use thereof.

BACKGROUND OF THE INVENTION

Zoonotic coronaviruses (CoV) are responsible for three epidemics in the 21st century, including severe acute respiratory syndrome coronavirus (SARS-CoV) in 2003 and the ongoing Middle East respiratory syndrome coronavirus (MERS-CoV) in 2012. In December 2019, a third novel CoV designated SARS-CoV-2 emerged and has resulted in a worldwide pandemic with over 25 million cases and over 850,000 deaths in over 220 countries. SARS-CoV-2 infection results in a complex clinical syndrome, designated Coronavirus Disease 2019 (COVID-19), that causes a range of clinical symptoms from mild to severe disease associated with acute lung injury (ALI) and acute respiratory distress syndrome (ARDS). SARS-CoV-2 infection can also produce strokes, cardiac pathology, gastrointestinal disease, coagulopathy, and a hyperinflammatory shock syndrome. The elderly, and those with underlining co-morbidities, are at increased risk of severe COVID-19 and death is most commonly linked to respiratory failure due to ARDS. The mortality rate from COVID-19 ARDS approaches 40% to 50%, perhaps associated with a "cytokine storm," characterized by elevated levels of IFN, IL-18, TGF, IL-6, IP-10, MCP-1, MIG, and IL-8.

SARS-CoV-2 uses the human angiotensin-converting enzyme 2 (hACE2) as a receptor for docking and entry into cells but is incapable of using the murine ortholog (mACE2) receptor. To generate SARS-CoV-2 mouse models, several groups have developed transgenic mouse lines expressing hACE2, utilizing a variety of exogenous or murine promoters, or by transduction using adenovirus or adeno-associated virus vectors, to generate productive infections. While each system has certain advantages, e.g., speed of development, infection in vector-mediated or transgenic overexpression models typically cause a mild alveolitis in the lung and/or progression to fatal encephalitis, rarely recapitulating the severe lung disease that is the hallmarks of COVID-19 in humans, and/or produce a fatal encephalitis.

There is a need to develop models that use standard laboratory mice which reproduce disease course in humans. The present invention overcomes shortcomings in the art by providing mouse-adapted SARS-CoV-2 viruses which reproduce age-dependent SARS-CoV-2 susceptibility, target nasal epithelia and alveolar pneumocytes, and develop the relevant pulmonary lesions of acute lung injury (including pneumonitis, edema, necrotic debris, and hyaline membrane formation) that are consistent with progression to ARDS.

SUMMARY OF THE INVENTION

A first aspect of the present invention provides a recombinant SARS-Cov-2 virus particle comprising: a spike protein comprising a Q493K, Q498Y and/or P499T substitution(s); a nsp4 protein comprising a T285I, G309C and/or H313Y substitution(s); a nsp7 protein comprising a K2R substitution; a nsp8 protein comprising a E23G and/or K196R substitution; a nsp9 protein comprising a T67A substitution; a ORF6 protein comprising a F7S substitution; and/or a nanoluciferase (nLUC) luminescence reporter sequence substituted in place of a wildtype ORF7, wherein the numbering is based on the reference amino acid sequence of SEQ ID NO:2 (spike protein), SEQ ID NO:3 (nsp4 protein), SEQ ID NO:4 (nsp7 protein), SEQ ID NO:5 (nsp8 protein), SEQ ID NO:6 (nsp9 protein) or SEQ ID NO:7 (ORF6 protein), respectively.

In further aspects, the present invention provides an isolated nucleic acid molecule encoding the SARS-CoV-2 virus particle of the present invention. In some embodiments, the isolated nucleic acid molecule may comprise, consist essentially of, or consist of the nucleotide sequence of SEQ ID NO:8, 9, 10, 11, 12, 13, 14, 15, 16,17, 18, 19, 20, 21, 22, 23, 24, 25, 26, 27, 28, 29, 30, 31, 32, 33, 34, 35, 36, 37, 38, 39, or 40.

Another aspect of the present invention provides an isolated nucleic acid molecule encoding a SARS-CoV-2 particle, wherein the nucleic acid molecule comprises one or more of the following nonsynonymous nucleotide substitutions, wherein the numbering is based on the reference nucleotide sequence of SEQ ID NO:1: G9479T, C9491T, A12678G, A12884G, C23039A, C9438T, A11847G, A12159G, T27221C, C23054T, A23056C, C23057A, C23059G.

In further aspects, the present invention provides vectors, particles, and compositions comprising the isolated nucleic acid molecule of this invention. Also provided are isolated nucleic acid molecules, particles, and/or vectors of this invention in a pharmaceutically acceptable carrier.

Another aspect of the present invention provides a method of producing an immune response to a coronavirus in a subject, comprising administering to the subject an effective amount of a SARS-CoV-2 particle of the present invention.

Another aspect of the present invention provides a method of identifying an agent effective in inhibiting coronavirus replication, the method comprising: (a) contacting a sample comprising the agent with a virus particle of the present invention wherein the virus particle comprises the nLUC luminescence reporter sequence substituted in place of wildtype ORF7 under conditions whereby viral replication can occur; (b) measuring the amount of luminescence in the sample; and (c) comparing the amount of luminescence in the sample to the level of luminescence in a control sample contacted with the virus particle of step (a) under conditions whereby viral replication occurs uninhibited, wherein a less amount of luminescence in the sample as compared to the control sample indicates inhibition of viral replication, thereby identifying an agent effective in inhibiting coronavirus replication.

These and other aspects of the invention are set forth in more detail in the description of the invention below.

BRIEF DESCRIPTION OF THE DRAWINGS

FIG. 1A shows an amino acid table of group 2B spike receptor binding domains (RBDs). Amino acid positions are numbered above in reference to SARS-CoV-1, and below in reference to SARS-CoV-2. SARS-CoV-1 Urbani, SARS-CoV-1 MA15, WIV1, and SHC014 can utilize mACE2 as a functional receptor whereas SARS-CoV-2 cannot. Residue Q498 in SARS-CoV-2 is a hACE2 contact for both SARS-CoV-1 and SARS-CoV-2, and is uniquely divergent in SARS-CoV-2. FIG. 1B shows a graph of single step growth curve of SARS-CoV-2 WT and SARS-CoV-2 MA in Vero E6 cells (n=3 for each group, serially sampled). Dotted line represents limit of detection. Log transformed data analyzed by 2-factor ANOVA followed by Sidak's multiple comparisons. FIG. 1C shows a bar graph of non-permissive DBT-9 cells transfected to express hACE2 or mACE2 and infected with SARS-CoV-2 WT and SARS-CoV-2 MA. Viral RNA was quantified by qRT-PCR and scaled to empty vector transfected cells (n=3 for each group). Dotted line represents fold change of 1. Log transformed data analyzed by 2-factor ANOVA followed by Dunnett's multiple comparisons. The line represents the mean and error bars represent standard deviation. Asterisk denotes $p<0.05$.

FIG. 2 panel A shows a plot of percent starting weight. Dotted line represents weight loss criteria for humane euthanasia. Data analyzed by mixed effects analysis followed by Dunnett's multiple comparisons. FIG. 2 panel B shows a plot of viral lung titer. Dotted line represents limit of detection. Undetected samples are plotted at half the limit of detection. Log transformed data analyzed by 2-factor ANOVA followed by Sidak's multiple comparisons. FIG. 2 panel C shows a plot of nasal turbinate titer. Dotted line represents limit of detection. 'ND' denotes titers not determined. Undetected samples are plotted at half the limit of detection. FIG. 2 panel D and panel E show plots of whole body plethysmography assessing pulmonary function for PenH (D) and Rpef (E). Data analyzed by 2-factor ANOVA followed by Dunnett's multiple comparisons. The line represents the mean and error bars represent standard error of the mean. Asterisk denotes $p<0.05$.

FIG. 3 panel A shows a plot of percent starting weight. Dotted line represents weight loss criteria for humane euthanasia. Data analyzed by mixed effects analysis followed by Dunnett's multiple comparisons. FIG. 3 panel B shows a plot of viral lung titer. Dotted line represents limit of detection. Undetected samples are plotted at half the limit of detection. Log transformed data analyzed by 2-factor ANOVA followed by Sidak's multiple comparisons. FIG. 3 panel C shows a plot of nasal turbinate titer. Dotted line represents limit of detection. 'ND' denotes titers not determined. Undetected samples are plotted at half the limit of detection. FIG. 3 panel D and panel E show plots of whole body plethysmography assessing pulmonary function for PenH (D) and Rpef (E). Data analyzed by 2-factor ANOVA followed by Dunnett's multiple comparisons. The line represents the mean and error bars represent standard error of the mean. Asterisk denotes $p<0.05$.

FIG. 4 panels A, B, and C show plots from groups of 10-week-old female BALB/c mice that were vaccinated with VRPs expressing wildtype spike (S, n=10), nucleocapsid (N, n=8), or GFP (n=4). Mice were boosted 3 weeks after prime immunization, bled 3 weeks post boost for neutralization assays, and challenged with SARS-CoV-2 MA at 4 weeks post boost. FIG. 4 panel A shows a plot of 50% inhibitory concentration ($IC_{50}$) values of sera from neutralization of SARS-CoV-2 WT. Dotted line represents limit of detection. Log transformed data analyzed by Kruskal Wallis test followed by Dunnett's multiple comparisons. FIG. 4 panel B shows a plot of lung viral titer. Dotted line represents limit of detection. Undetected samples are plotted at half the limit of detection. Log transformed data analyzed as in panel A. FIG. 4 panel C shows a plot of nasal turbinate viral titer. Log transformed data analyzed as in panel A. FIG. 4 panel D shows a plot of human primary airway epithelial cells pretreated for 24 hrs with peg-IFN-λ1 followed by infection with SARS-CoV-2 WT. Infectious virus in apical washes from 48 hours post infection was titered. Remdesivir (RDV) was used as positive control. Dotted line represents limit of detection. Undetected samples are plotted at half the limit of detection. This study was repeated in cells from two unique human donors. FIG. 4 panels E and F show plots from 12-week-old female BALB/c mice subcutaneously treated with vehicle or with 2 µg peg-IFN-λ1 prophylactically or therapeutically and infected with SARS-CoV-2 MA. FIG. 4 panel E shows a plot of lung viral titer. Dotted line represents limit of detection. Log transformed data analyzed by Kruskal Wallis test followed by Dunnett's multiple comparisons. FIG. 4 panel F shows a plot of nasal turbinate viral titer. Dotted line represents limit of detection. Log transformed data analyzed by Kruskal Wallis test followed by Dunnett's multiple comparisons. The line represents the mean and error bars represent standard error of the mean. Asterisk denotes $p<0.05$.

(FIG. 5E). n=3 for each group, sampled serially. Dotted line represents limit of detection. Log transformed data was analyzed by 2-factor ANOVA followed by Sidak's multiple corrections. Asterisks represent p<0.05.

FIG. 6A shows a plot of percent starting weight. Data analyzed by mixed effects analysis followed by Sidak's multiple comparisons. FIG. 6B shows a plot of survival rate. FIG. 6C shows a plot of gross lung congestion score. Data analyzed by 2-factor ANOVA followed by Sidak's multiple comparisons. FIG. 6D shows a plot of viral lung titer (Mock infected: 1 dpi: n=6; 2 dpi: n=7; 3 dpi: n=6; 4 dpi: n=7; 5 dpi: n=6; 6 dpi: n=6; 7 dpi: n=9; SARS-CoV-2 MA10 infected: 1 dpi: n=7; 2 dpi: n=10; 3 dpi: n=7; 4 dpi: n=10; 5 dpi: n=7; 6 dpi: n=7; 7 dpi: n=9). Dotted line represents limit of detection. Undetected samples are plotted at half the limit of detection. Log transformed data analyzed as in FIG. 6C. FIG. 6E shows a plot of viral nasal cavity titer Dotted line represents limit of detection. Undetected samples are plotted at half the limit of detection. FIGS. 6F-6H show plots of whole body plethysmography analysis of lung function parameters (10 mice per group at 0 dpi): PenH (FIG. 6F), Rpef (FIG. 6G), and EF50 (FIG. 6H). Data analyzed as in FIG. 6A. All error bars represent standard error of the mean about the mean. Asterisks represent p<0.05.

FIG. 7A shows a plots of percent starting weight. Dotted line represents 70% starting body weight. Data analyzed by mixed effects analysis followed by Sidak's multiple comparisons. FIG. 7B shows a plot of survival rate analyzed by log rank test. FIG. 7C shows a plot of gross lung congestion score. Data analyzed by 2-factor ANOVA followed by Sidak's multiple comparisons. FIG. 7D shows a plot of lung viral titer. (Mock infected: 1 dpi: n=6; 2 dpi: n=7; 3 dpi: n=6; 4 dpi: n=7; 5 dpi: n=6; 6 dpi: n=6; 7 dpi: n=13; SARS-CoV-2 MA10 infected: 1 dpi: n=6; 2 dpi: n=10; 3 dpi: n=7; 4 dpi: n=8; 5 dpi: n=1; 6 dpi: n=2; 7 dpi: n=3.) Dotted line represents limit of detection. Undetected samples are plotted at half the limit of detection. Log transformed data analyzed as in FIG. 7C.

FIG. 8A shows a plot of percent starting weight. Data analyzed by mixed effects analysis followed by Sidak's multiple comparisons. FIG. 8B shows a plot of gross lung congestion score. Data analyzed by 2-factor ANOVA followed by Sidak's multiple comparisons. FIG. 8C shows a plot of viral lung titer of mice from FIG. 8A. (Mock infected: 1 dpi: n=6; 2 dpi: n=7; 3 dpi: n=5; 4 dpi: n=7; 5 dpi: n=6; 6 dpi: n=6; 7 dpi: n=8; SARS-CoV-2 MA10 infected: 1 dpi: n=7; 2 dpi: n=8; 3 dpi: n=7; 4 dpi: n=10; 5 dpi: n=4; 6 dpi: n=7; 7 dpi: n=11). Dotted line represents limit of detection. Undetected samples are plotted at half the limit of detection. Log transformed data analyzed as in FIG. 8B.

(FIG. 9 panel A) Percent starting weight. Dotted line represents 80% starting body weight. Data analyzed by mixed effects analysis followed by Sidak's multiple comparisons. Statistical comparisons shown between MA10 infected WT and MA10 infected IFNR DKO mice. (FIG. 9 panel B) Gross lung congestion score of mice from FIG. 9 panel A. Data analyzed by 2-factor ANOVA followed by Tukey's multiple comparisons. (FIG. 9 panel C) Viral lung titer of mice from FIG. 9 panel A. (Mock infected: 2 dpi: n=6 WT & 5 IFNR DKO; 4 dpi: n=6 WT and 6 IFNR DKO: SARS-CoV-2 MA10 infected: 2 dpi: n=8 WT & 6 IFNR DKO; 4 dpi: n=10 WT & 6 IFNR DKO). Dotted line represents limit of detection. Undetected samples are plotted at half the limit of detection. Log transformed data analyzed via 2-factor ANOVA followed by Tukey's multiple comparisons. (FIG. 9 panels D, E, and F) Whole body plethysmography analysis of lung function parameters (6 mice per group) at 0 dpi): PenH (D), Rpef (E), and EF50 (F). Data analyzed using 2-factor ANOVA followed by Sidak's multiple comparisons. Error bars represent standard error of the mean about the mean. Asterisks represent p<0.05.

(FIG. 14 panels A and B) mAbs (panel A) and COVID-19 sera (panel B) against icMERS-CoV-nLuc. (FIG. 14 panels C and D) mAbs (panel C) and SARS and COVID-19 sera (panel D) against icSARS-CoV-nLuc. (FIG. 14 panels E-G) mAbs (panel E), SARS and COVID-19 sera (panel F), and vaccinated mouse serum (panel G) against icSARS-CoV-2-nLuc-GFP. (FIG. 14 panel H) $ID_{50}$ values of SARS and COVID-19 sera cross-neutralizing SARS-CoV and SARS-CoV-2. The same serum samples are indicated with arrows. The MERS-CoV neutralizing mAbs were the following: MERS-27 and m336; the SARS-CoV neutralizing mAbs were the following: S230, S230.15, and S227.9; the dengue virus mAb was the following: EDE1-C10. SARS patient serum samples are labeled as "A" to "E"; COVID-19 patient serum samples are labeled as "1" to "10." Mouse serum was produced by BALB/c mice immunized with SARS-CoV-2 spike.

DETAILED DESCRIPTION

Figure 2:
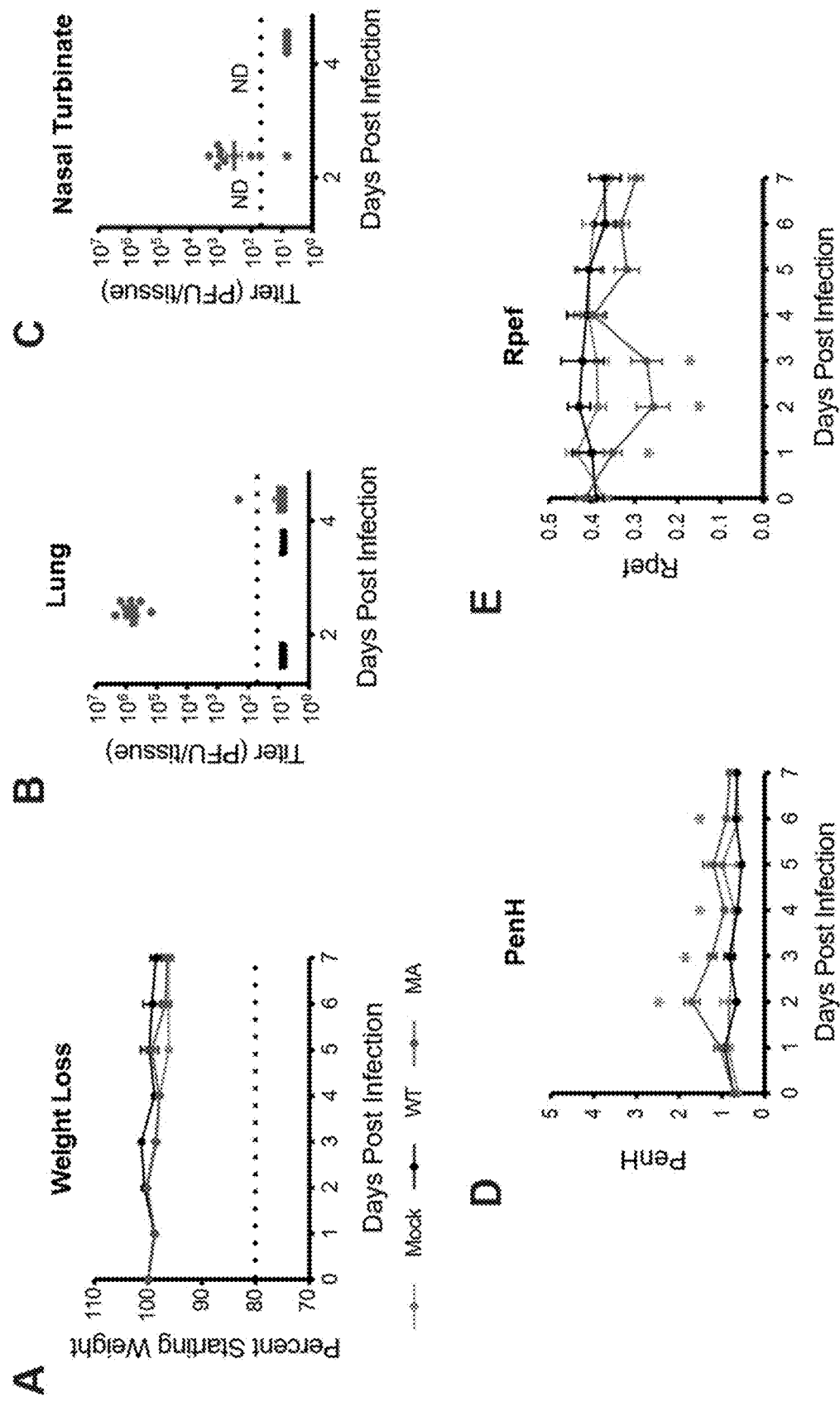
FIG. 2 shows data plots from experiments of SARS-CoV-2 MA replicates in young BALB/c mice. 12-week-old female BALB/c mice were mock infected, or infected with 105 PFU SARS-CoV-2 WT or MA. n=27, 15, 33, respectively. Mice were harvested on day 2, 4 and 7 after infection (n=5-14 per time point). Data combined from two independent experiments.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations, and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measurable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

The term "sequence identity," as used herein, has the standard meaning in the art. As is known in the art, a number of different programs can be used to identify whether a polynucleotide or polypeptide has sequence identity or similarity to a known sequence. Sequence identity or similarity may be determined using standard techniques known in the art, including, but not limited to, the local sequence identity algorithm of Smith & Waterman, *Adv. Appl. Math.* 2:482 (1981), by the sequence identity alignment algorithm of Needleman & Wunsch, *J. Mol. Biol.* 48:443 (1970), by the search for similarity method of Pearson & Lipman, *Proc. Natl. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., *Nucl. Acid Res.* 12:387 (1984), preferably using the default settings, or by inspection.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, J. Mol. Evol. 35:351 (1987); the method is similar to that described by Higgins & Sharp, CABIOS 5:151 (1989).

Another example of a useful algorithm is the BLAST algorithm, described in Altschul et al., *J. Mol. Biol.* 215:403 (1990) and Karlin et al., Proc. Natl. Acad. Sci. USA 90:5873 (1993). A particularly useful BLAST program is the WU-BLAST-2 program which was obtained from Altschul et al., Meth. Enzymol. 266:460 (1996); blast.wustl/edu/blast/README.html. WU-BLAST-2 uses several search parameters, which are preferably set to the default values. The parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., *Nucleic Acids Res.* 25:3389 (1997).

A percentage amino acid sequence identity value is determined by the number of matching identical residues divided by the total number of residues of the "longer" sequence in the aligned region. The "longer" sequence is the one having the most actual residues in the aligned region (gaps introduced by WU-Blast-2 to maximize the alignment score are ignored).

In a similar manner, percent nucleic acid sequence identity is defined as the percentage of nucleotide residues in the candidate sequence that are identical with the nucleotides in the polynucleotide specifically disclosed herein.

The alignment may include the introduction of gaps in the sequences to be aligned. In addition, for sequences which contain either more or fewer nucleotides than the polynucleotides specifically disclosed herein, it is understood that in one embodiment, the percentage of sequence identity will be determined based on the number of identical nucleotides in relation to the total number of nucleotides. Thus, for example, sequence identity of sequences shorter than a sequence specifically disclosed herein, will be determined using the number of nucleotides in the shorter sequence, in one embodiment. In percent identity calculations relative weight is not assigned to various manifestations of sequence variation, such as insertions, deletions, substitutions, etc.

In one embodiment, only identities are scored positively (+1) and all forms of sequence variation including gaps are assigned a value of "0," which obviates the need for a weighted scale or parameters as described below for sequence similarity calculations. Percent sequence identity can be calculated, for example, by dividing the number of matching identical residues by the total number of residues of the "shorter" sequence in the aligned region and multiplying by 100. The "longer" sequence is the one having the most actual residues in the aligned region.

As used herein, an "isolated" nucleic acid or nucleotide sequence (e.g., an "isolated DNA" or an "isolated RNA") means a nucleic acid or nucleotide sequence separated or substantially free from at least some of the other components of the naturally occurring organism or virus, for example, the cell or viral structural components or other polypeptides or nucleic acids commonly found associated with the nucleic acid or nucleotide sequence.

Likewise, an "isolated" polypeptide means a polypeptide that is separated or substantially free from at least some of the other components of the naturally occurring organism or virus, for example, the cell or viral structural components or other polypeptides or nucleic acids commonly found associated with the polypeptide.

Furthermore, an "isolated" cell is a cell that has been partially or completely separated from other components with which it is normally associated in nature. For example, an isolated cell can be a cell in culture medium and/or a cell in a pharmaceutically acceptable carrier.

The term "endogenous" refers to a component naturally found in an environment, i.e., a gene, nucleic acid, miRNA, protein, cell, or other natural component expressed in the subject, as distinguished from an introduced component, i.e., an "exogenous" component.

As used herein, the term "heterologous" refers to a nucleotide/polypeptide that originates from a foreign species, or, if from the same species, is substantially modified from its native form in composition and/or genomic locus by deliberate human intervention.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or modified nucleotide bases. The term "nucleotide sequence" or "nucleic acid sequence" refers to both the sense and antisense strands of a nucleic acid as either individual single strands or in the duplex.

The terms "nucleic acid segment," "nucleotide sequence," "nucleic acid molecule," or more generally "segment" will be understood by those in the art as a functional term that includes both genomic DNA sequences, ribosomal RNA sequences, transfer RNA sequences, messenger RNA sequences, small regulatory RNAs, operon sequences and smaller engineered nucleotide sequences that express or may be adapted to express, proteins, polypeptides or peptides. Nucleic acids of the present disclosure may also be synthesized, either completely or in part, by methods known in the art. Thus, all or a portion of the nucleic acids of the present codons may be synthesized using codons preferred by a selected host. Species-preferred codons may be determined, for example, from the codons used most frequently in the proteins expressed in a particular host species. Other modifications of the nucleotide sequences may result in mutants having slightly altered activity.

As used herein with respect to nucleic acids, the term "fragment" refers to a nucleic acid that is reduced in length relative to a reference nucleic acid and that comprises, consists essentially of and/or consists of a nucleotide sequence of contiguous nucleotides identical or almost identical (e.g., 90%, 91%, 92%, 93%, 94%, 95%, 96%, 97%, 98%, 99% identical) to a corresponding portion of the reference nucleic acid. Such a nucleic acid fragment may be, where appropriate, included in a larger polynucleotide of which it is a constituent. In some embodiments, the nucleic acid fragment comprises, consists essentially of or consists of at least about 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450, 500, or more consecutive nucleotides. In some embodiments, the nucleic acid fragment comprises, consists essentially of or consists of less than about 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450 or 500 consecutive nucleotides.

As used herein with respect to polypeptides, the term "fragment" refers to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450, 500, or more consecutive amino acids. In some embodiments, the polypeptide fragment comprises, consists essentially of or consists of less than about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450 or 500 consecutive amino acids.

As used herein with respect to nucleic acids, the term "functional fragment" or "active fragment" refers to nucleic acid that encodes a functional fragment of a polypeptide.

As used herein with respect to polypeptides, the term "functional fragment" or "active fragment" refers to polypeptide fragment that retains at least about 20%, 25%, 30%, 35%, 40%, 45%, 50%, 55%, 60%, 65%, 70%, 75%, 80%, 85%, 90%, 95%, 96%, 97%, 98%, 99%, 99.5% or more of at least one biological activity of the full-length polypeptide (e.g., the ability to up- or down-regulate gene expression). In some embodiments, the functional fragment actually has a higher level of at least one biological activity of the full-length polypeptide.

As used herein, the term "modified," as applied to a polynucleotide or polypeptide sequence, refers to a sequence that differs from a wild-type sequence due to one or more deletions, additions, substitutions, or any combination thereof. Modified sequences may also be referred to as "modified variant(s)."

As used herein, by "isolate" or "purify" (or grammatical equivalents) a vector, it is meant that the vector is at least partially separated from at least some of the other components in the starting material.

The term "enhance" or "increase" refers to an increase in the specified parameter of at least about 1.25-fold, 1.5-fold, 2-fold, 3-fold, 4-fold, 5-fold, 6-fold, 8-fold, 10-fold, twelve-fold, or even fifteen-fold, and/or at least about 5%, 10%, 15%, 20%, 25%, 30%, 35%, 40%, 45%, 50%, 55%, 60%, 65%, 70%, 75%, 80%, 85%, 90%, 95%, or 100% or more, or any value or range therein.

The term "inhibit" or "reduce" or grammatical variations thereof as used herein refers to a decrease or diminishment in the specified level or activity of at least about 15%, 25%, 35%, 40%, 50%, 60%, 75%, 80%, 90%, 95% or more. In particular embodiments, the inhibition or reduction results in little or essentially no detectable activity (at most, an insignificant amount, e.g., less than about 10% or even 5%).

As used herein, "expression" refers to the process by which a polynucleotide is transcribed from a DNA template (such as into an mRNA or other RNA transcript) and/or the process by which a transcribed mRNA is subsequently translated into peptides, polypeptides, or proteins. Transcripts may be referred to as "transcription products" and encoded polypeptides may be referred to as "translation products." Transcripts and encoded polypeptides may be collectively referred to as "gene products." If the polynucleotide is derived from genomic DNA, expression may include splicing of the mRNA in a eukaryotic cell. The expression product itself, e.g., the resulting nucleic acid or protein, may also be said to be "expressed." An expression product can be characterized as intracellular, extracellular, or secreted. The term "intracellular" means something that is inside a cell. The term "extracellular" means something that is outside a cell. A substance is "secreted" by a cell if it appears in significant measure outside the cell, from somewhere on or inside the cell.

The terms "amino acid sequence," "polypeptide," "peptide" and "protein" may be used interchangeably to refer to polymers of amino acids of any length. The terms "nucleic acid," "nucleic acid sequence," and "polynucleotide" may be used interchangeably to refer to polymers of nucleotides of any length. As used herein, the terms "nucleotide sequence," "polynucleotide," "nucleic acid sequence," "nucleic acid molecule" and "nucleic acid fragment" refer to a polymer of RNA, DNA, or RNA and DNA that is single- or double-stranded, optionally containing synthetic, non-natural and/or altered nucleotide bases.

As used herein, the terms "gene of interest," "nucleic acid of interest" and/or "protein of interest" refer to that gene/nucleic acid/protein desired under specific contextual conditions.

As used herein, the term "chimera," "chimeric," and/or "fusion protein" refer to an amino acid sequence (e.g., polypeptide) generated non-naturally by deliberate human design comprising, among other components, an amino acid sequence of a protein of interest and/or a modified variant and/or active fragment thereof (a "backbone"), wherein the protein of interest comprises modifications (e.g., substitutions such as singular residues and/or contiguous regions of amino acid residues) from different wild type reference sequences (chimera), optionally linked to other amino acid segments (fusion protein). The different components of the designed protein may provide differing and/or combinatorial function. Structural and functional components of the designed protein may be incorporated from differing and/or a plurality of source material. The designed protein may be delivered exogenously to a subject, wherein it would be exogenous in comparison to a corresponding endogenous protein.

As used herein with respect to nucleic acids, the term "operably linked" refers to a functional linkage between two or more nucleic acids. For example, a promoter sequence may be described as being "operably linked" to a heterologous nucleic acid sequence because the promoter sequence initiates and/or mediates transcription of the heterologous nucleic acid sequence. In some embodiments, the operably linked nucleic acid sequences are contiguous and/or are in the same reading frame.

By the term "treat," "treating," or "treatment of" (or grammatically equivalent terms) it is meant that the severity of the subject's condition is reduced or at least partially improved or ameliorated and/or that some alleviation, mitigation or decrease in at least one clinical symptom is achieved and/or there is a delay in the progression of the condition and/or prevention or delay of the onset of a disease or disorder.

As used herein, the term "prevent," "prevents," or "prevention" (and grammatical equivalents thereof) refers to a delay in the onset of a disease or disorder or the lessening of symptoms upon onset of the disease or disorder. The terms are not meant to imply complete abolition of disease and encompass any type of prophylactic treatment that reduces the incidence of the condition or delays the onset and/or progression of the condition.

As used herein, "effective amount" or "therapeutic amount" refers to an amount of a population or composition or formulation of this invention that is sufficient to produce a desired effect, which can be a therapeutic effect. The effective amount will vary with the age, general condition of the subject, the severity of the condition being treated, the particular agent administered, the duration of the treatment, the nature of any concurrent treatment, the pharmaceutically acceptable carrier used, and like factors within the knowledge and expertise of those skilled in the art. As appropriate, an effective amount or therapeutic amount in any individual case can be determined by one of ordinary skill in the art by reference to the pertinent texts and literature and/or by using routine experimentation. (See, for example, Remington, *The Science and Practice of Pharmacy* (20th ed. 2000)).

An "immunogenic amount" is an amount of the compositions of this invention that is sufficient to elicit, induce and/or enhance an immune response in a subject to which the composition is administered or delivered.

A "treatment effective" amount as used herein is an amount that is sufficient to provide some improvement or benefit to the subject. Alternatively stated, a "treatment effective" amount is an amount that will provide some alleviation, mitigation, decrease or stabilization in at least one clinical symptom in the subject. Those skilled in the art will appreciate that the therapeutic effects need not be complete or curative, as long as some benefit is provided to the subject.

A "prevention effective" amount as used herein is an amount that is sufficient to prevent and/or delay the onset of a disease, disorder and/or clinical symptoms in a subject and/or to reduce and/or delay the severity of the onset of a disease, disorder and/or clinical symptoms in a subject relative to what would occur in the absence of the methods of the invention. Those skilled in the art will appreciate that the level of prevention need not be complete, as long as some benefit is provided to the subject.

The term "administering" or "administration" of a composition of the present invention to a subject includes any route of introducing or delivering to a subject a compound to perform its intended function (e.g., for use as a vaccine antigen). Administration includes self-administration and the administration by another.

As used herein, the term "antigen" refers to a molecule capable of inducing the production of immunoglobulins (e.g., antibodies). The term "immunogen" can be used interchangeably with "antigen" under certain conditions, e.g., when the antigen is capable of inducing a multi-faceted humoral and/or cellular-mediated immune response. A molecule capable of antibody and/or immune response stimulation may be referred to as antigenic/immunogenic, and can be said to have the ability of antigenicity/immunogenicity. The binding site for an antibody within an antigen and/or immunogen may be referred to as an epitope (e.g., an antigenic epitope). The term "vaccine antigen" as used herein refers to such an antigen/immunogen as used as a vaccine, e.g., a prophylactic, preventative, and/or therapeutic vaccine.

A "vector" refers to a compound used as a vehicle to carry foreign genetic material into another cell, where it can be replicated and/or expressed. A cloning vector containing foreign nucleic acid is termed a recombinant vector. Examples of nucleic acid vectors are plasmids, viral vectors, cosmids, expression cassettes, and artificial chromosomes. Recombinant vectors typically contain an origin of replication, a multicloning site, and a selectable marker. The nucleic acid sequence typically consists of an insert (recombinant nucleic acid or transgene) and a larger sequence that serves as the "backbone" of the vector. The purpose of a vector which transfers genetic information to another cell is typically to isolate, multiply, or express the insert in the target cell. Expression vectors (expression constructs or expression cassettes) are for the expression of the exogenous gene in the target cell, and generally have a promoter sequence that drives expression of the exogenous gene. Insertion of a vector into the target cell is referred to transformation or transfection for bacterial and eukaryotic cells, although insertion of a viral vector is often called transduction. The term "vector" may also be used in general to describe items to that serve to carry foreign genetic material into another cell, such as, but not limited to, a transformed cell or a nanoparticle.

As used herein, the term "synthetic" or "recombinant" refers to a non-naturally occurring entity (e.g., virus particle, nucleic acid molecule, and/or protein) that differs in nucleotide or amino acid sequence from a wild-type counterpart, e.g., the recombinant SARS-CoV-2 virus particle sequence due to one or more deletions, additions, substitutions, or any combination thereof. The difference between the recombinant and wild-type virus particle, protein, and/or nucleic sequences may be as little as a single nucleotide change, e.g., a change in 1, 2, 3, 4, 5,6, 7, 8, 9, 10, 15, 20, 25, 30, 35, 40, 45, 50, 60, 60, 70, 80, 90, or 100 or more nucleotides or any range therein. Recombinant virus particles, proteins, and isolated nucleic acid molecules according to the present invention find use in both veterinary and medical applications.

A "subject" of the invention may include any animal in need thereof. In some embodiments, a subject may be, for example, a mammal, a reptile, a bird, an amphibian, or a fish. A mammalian subject may include, but is not limited to, a laboratory animal (e.g., a rat, mouse, guinea pig, rabbit, primate, etc.), a farm or commercial animal (e.g., cattle, pig, horse, goat, donkey, sheep, etc.), or a domestic animal (e.g., cat, dog, ferret, gerbil, hamster etc.). In some embodiments, a mammalian subject may be a primate, or a non-human primate (e.g., a chimpanzee, baboon, macaque (e.g., rhesus macaque, crab-eating macaque, stump-tailed macaque, pig-tailed macaque), monkey (e.g., squirrel monkey, owl monkey, etc.), marmoset, gorilla, etc.). In some embodiments, a mammalian subject may be a human. In some embodiments, a bird may include, but is not limited to, a chicken, a duck, a turkey, a goose, a quail, a pheasant, a parakeet, a parrot, a macaw, a cockatoo, or a canary.

A "subject in need" of the methods of the invention can be any subject known to have a coronavirus infection and/or an illness to which inhibition of coronavirus infection may provide beneficial health effects, or a subject having an increased risk of developing the same).

A "sample" or "biological sample" of this invention can be any biological material, such as a biological fluid, an extract from a cell, an extracellular matrix isolated from a cell, a cell (in solution or bound to a solid support), a tissue, a tissue homogenate, and the like as are well known in the art.

"Nidovirus" as used herein refers to viruses within the order Nidovirales, including the families Coronaviridae and Arteriviridae. All viruses within the order Nidovirales share the unique feature of synthesizing a nested set of multiple subgenomic mRNAs. See Lai and Holmes, "Coronaviridae: The Viruses and Their Replication" in Fields *Virology*, pg 1163, ($4^{th}$ Ed. 2001). Particular examples of Coronaviridae include, but are not limited to, toroviruses and coronaviruses.

"Coronavirus" as used herein refers to a genus in the family Coronaviridae, which family is in turn classified within the order Nidovirales. The coronaviruses are large, enveloped, positive-stranded RNA viruses. They have the largest genome of all RNA viruses and replicate by a unique mechanism that results in a high frequency of recombination. The coronaviruses include antigenic groups I, II, and III. Nonlimiting examples of coronaviruses include SARS coronavirus (SARS-CoV, also known as SARS-CoV-1), SARS-CoV-2 (also known as 2019 novel coronavirus (2019-nCoV) or human coronavirus 2019 (HCoV-19 or hCoV-19), MERS coronavirus, transmissible gastroenteritis virus (TGEV), human respiratory coronavirus, porcine respiratory coronavirus, canine coronavirus, feline enteric coronavirus, feline infectious peritonitis virus, rabbit coronavirus, murine hepatitis virus, sialodacryoadenitis virus, porcine hemagglutinating encephalomyelitis virus, bovine coronavirus, avian infectious bronchitis virus, and turkey coronavirus, as well as chimeras of any of the foregoing. See Lai and Holmes "Coronaviridae: The Viruses and Their Replication" in Fields *Virology*, ($4^{th}$ Ed. 2001).

A "nidovirus permissive cell" or "coronavirus permissive cell" as used herein can be any cell in which a coronavirus can at least replicate, including both naturally occurring and recombinant cells. In some embodiments the permissive cell is also one that the nidovirus or coronavirus can infect. The permissive cell can be one that has been modified by recombinant means to produce a cell surface receptor for the nidovirus or coronavirus.

Compositions

The present invention relates to the design of SARS-CoV-2 viruses that are adapted facilitate efficient binding to murine angiotensin converting enzyme 2 (mACE2) while reproducing human-like SARS-CoV-2 infection parameters (e.g., "mouse-adapted"). The genome of SARS-CoV-2 is about 30 kb RNA predicted to encode 16 non-structural proteins (nsp1-nsp16), four structural proteins (spike, membrane, envelope, and nucleocapsid), and eight accessory proteins (3a, 3b, 6, 7a, 7b, 8b, 9b, and 14), expressed from genome-length or sub-genomic mRNAs. The spike (S) glycoprotein mediates viral entry via binding to the human angiotensin-converting enzyme (hACE2), followed by proteolytic processing by transmembrane protease, serine 2 (TMPRSS2), furin and other lung proteases, which trigger fusion of viral and cellular membranes. Spike glycoprotein is also the main target of host neutralizing antibodies (nAbs).

SARS-CoV-2 infection primarily targets the respiratory tract. A fraction of SARS-CoV-2 infections manifest as bilateral lower-zone pneumonias and diffuse alveolar damage (DAD) that may progress to acute respiratory distress syndrome (ARDS), especially in the aged and individuals with co-morbidities. In comparison to symptoms of MERS-CoV and SARS-CoV 2003 infections, clinical symptoms of COVID-19 are broader and more variable. Differences in transmissibility and viral shedding suggest the in vivo replication sites and/or replication efficiency of SARS-CoV-2 differ significantly from SARS-CoV.

Due to these differences in SARS-CoV-2 versus previous coronavirus infections, animal models and model-adapted SARS-CoV-2 viruses are needed which replicate human infection pathology. Such models, especially if available in standard laboratory mice, may accelerate studies of COVID-19 immune pathologies, the function of host genes in regulating disease progression, and will provide a high-throughput screening platform for evaluating antiviral drugs and vaccines.

Accordingly, one aspect of the present invention provides a recombinant SARS-CoV-2 virus particle comprising one or more amino acid substitution(s) in a spike protein, nsp4 protein, nsp7 protein, nsp8 protein, nsp9 protein, and/or a ORF6 protein, wherein the one or more amino acid substitution(s) adapts the virus particle to bind to mACE2.

In another aspect, the present invention provides a recombinant SARS-CoV-2 virus particle comprising a nanoluciferase (nLUC) luminescence reporter sequence substituted in place of a wildtype ORF7. The term "in place of" as used herein refers to any substantial replacement of a functioning ORF7. The replacement may be complete (e.g., the entire sequence of wildtype ORF7 is replaced), or the replacement may be partial (e.g., a subset of the sequence of wildtype ORF7 is replaced) to any degree wherein the remaining sequence of ORF7 is non-functional. For example, in some embodiments, a recombinant SARS-CoV-2 virus particle of the present invention may comprise a nLUC luminescence reporter sequence substituted in place of a region of about 100, 110, 120, 130, 140, 150, 160, 170, 180, 190, 200, 210, 220, 230, 240, 250, 260, 270, 280, 290, 300, 310, 320, 330, 340, 350, 360, 361, 362, 363, 364, 465, or 366 base-pairs or more of the WT SARS-CoV-2 ORF7 gene, or any value or range therein. In some embodiments, a recombinant SARS-CoV-2 virus particle of the present invention may comprise a nLUC luminescence reporter sequence substituted in a particular location in the WT SARS-CoV-2 ORF7 gene/protein, e.g., downstream of a ORF7 (e.g., ORF7a, ORF7b) transcription regulatory sequence. In some embodiments, a recombinant SARS-CoV-2 virus particle of the present invention may comprise a nLUC luminescence reporter sequence substituted in place of amino acid residues in positions 14-104 of the WT SARS-CoV-2 ORF7 protein.

In another aspect, the present invention provides a recombinant SARS-CoV-2 virus particle comprising: a spike protein comprising a Q493K, Q498Y and/or P499T substitution(s); a nsp4 protein comprising a T285I, G309C and/or H313Y substitution(s); a nsp7 protein comprising a K2R substitution; a nsp8 protein comprising a E23G and/or K196R substitution; a nsp9 protein comprising a T67A substitution; a ORF6 protein comprising a F7S substitution; and/or a nanoluciferase (nLUC) luminescence reporter sequence substituted in place of a wildtype ORF7, wherein the numbering is based on the reference amino acid sequence of SEQ ID NO:2 (spike protein), SEQ ID NO:3 (nsp4 protein), SEQ ID NO:4 (nsp7 protein), SEQ ID NO:5 (nsp8 protein), SEQ ID NO:6 (nsp9 protein) or SEQ ID NO:7 (ORF6 protein), respectively.

In another aspect, the present invention provides a recombinant SARS-CoV-2 spike protein comprising a Q493K, Q498Y and/or P499T substitution(s), wherein the numbering is based on the reference amino acid sequence of SEQ ID NO:2 (spike protein).

In another aspect, the present invention provides a recombinant SARS-CoV-2 nsp4 protein comprising a T285I, G309C and/or H313Y substitution(s), wherein the numbering is based on the reference amino acid sequence of SEQ ID NO:3 (nsp4 protein).

In another aspect, the present invention provides a recombinant SARS-CoV-2 nsp7 protein comprising a K2R substitution, wherein the numbering is based on the reference amino acid sequence of SEQ ID NO:4 (nsp7 protein).

In another aspect, the present invention provides a recombinant SARS-CoV-2 nsp8 protein comprising a E23G and/or K196R substitution, wherein the numbering is based on the reference amino acid sequence of SEQ ID NO:5 (nsp8 protein).

In another aspect, the present invention provides a recombinant SARS-CoV-2 nsp9 protein comprising a T67A substitution, wherein the numbering is based on the reference amino acid sequence of SEQ ID NO:6 (nsp9 protein).

In another aspect, the present invention provides a recombinant SARS-CoV-2 ORF6 protein comprising a F7S substitution, wherein the numbering is based on the reference amino acid sequence of SEQ ID NO:9 (ORF6 protein).

The recombinant SARS-CoV-2 virus particle and/or recombinant SARS-CoV-2 recombinant spike, nsp4, nsp7, nsp8, nsp9 and/or ORF6 protein of this invention may be derived from (e.g., comprise the backbone of and/or substitutions from) any SARS-CoV-2 coronavirus subgroup, strain, and/or isolate (e.g., clinical isolate) now known (e.g., as can be found in the GenBank® Database) or later identified, or any combination thereof. Non-limiting examples of SARS-CoV-2 strains and/or isolates include GenBank® Accession Nos. MT020880, MT461669, MT952602, NC 045512 and MN908947. Furthermore, the recombinant SARS-CoV-2 virus particle and/or recombinant SARS-CoV-2 recombinant spike, nsp4, nsp7, nsp8, nsp9 and/or ORF6 proteins produced from the respective SARS-CoV-2 coronavirus subgroup, strain, and/or isolate can be included in the methods and compositions of this invention, as would be well understood to one of ordinary skill in the art.

The amino acid residue positions of the substitutions that can be made to produce the desired recombinant SARS-CoV-2 virus particle and/or recombinant spike, nsp4, nsp7, nsp8, nsp9 and/or ORF6 protein of this invention can be readily determined by one of ordinary skill in the art according to the teachings herein and according to protocols well known in the art. The amino acid residue numbering provided in the amino acid sequences set forth here is based on the reference sequences of SARS-CoV-2 wild type spike, nsp4, nsp7, nsp8, nsp9 and/or ORF6 protein, as provided herein (SEQ ID NOs:2-7). However it would be readily understood by one of ordinary skill in the art that the equivalent amino acid positions in other SARS-CoV-2 sequences can be readily identified and employed in the production of the recombinant SARS-CoV-2 and/or recombinant spike, nsp4, nsp7, nsp8, nsp9 and/or ORF6 proteins of this invention.

In some embodiments, the present invention provides an isolated nucleic acid molecule encoding the SARS-CoV-2 virus particle of the invention. In some embodiments, a nucleic acid molecule of this invention may be a cDNA molecule. In some embodiments, a nucleic acid molecule of this invention may be an mRNA molecule.

It would be understood that the modifications described herein provide multiple examples of how the amino acid sequences described herein can be obtained and that, due to the degeneracy of the amino acid codons, numerous other modifications can be made to a nucleotide sequence encoding a recombinant SARS-CoV-2 virus particle and/or recombinant spike, nsp4, nsp7, nsp8, nsp9 and/or ORF6 protein or fragment thereof to obtain the desired amino acid sequence. The present invention provides additional non limiting examples of nucleic acids and/or polypeptides of this invention that can be used in the compositions and methods described herein in the Sequence Listing provided herewith.

Representative nonlimiting examples of a nucleic acid molecule of this invention are shown in the Sequence Listing provided herewith and further described below. It is to be understood that these examples are not intended to be limiting and any of these nucleotide and/or amino acid substitutions can be combined with any SARS-CoV-2 subgroup, strain, and/or isolate, to produce a recombinant SARS-CoV-2 virus particle and/or recombinant SARS-CoV-2 recombinant spike, nsp4, nsp7, nsp8, nsp9 and/or ORF6 protein of this invention.

Accordingly, for example, in some embodiments, the isolated nucleic acid molecule of the present invention comprises, consists essentially of, or consists of the nucleotide sequence of SEQ ID NO:13 (SARS-Cov-2-nLUC (in place of ORF7, silent mutation, GFP) GenBank MT461671) or a sequence at least about 70% identical thereto, e.g., at least about 70, 75, 80, 85, 90, 91, 92, 93, 94, 95, 96, 97, 98, or 99% identical thereto.

As another example, in some embodiments, the isolated nucleic acid molecule of the present invention comprises, consists essentially of, or consists of the nucleotide sequence of SEQ ID NO:14 (SARS-CoV-2-nLUC (no GFP); GenBank MT844089) or a sequence at least about 70% identical thereto, e.g., at least about 70, 75, 80, 85, 90, 91, 92, 93, 94, 95, 96, 97, 98, or 99% identical thereto.

In some embodiments, the present invention provides an isolated nucleic acid molecule encoding a SARS-CoV-2 particle, wherein the nucleic acid molecule comprises one or more of the following nonsynonymous nucleotide substitutions, wherein the numbering is based on the reference nucleotide sequence of SEQ ID NO:1 (SARS-CoV-2 WT; GenBank MT020880): G9479T, C9491T, A12678G, A12884G, C23039A, C9438T, A11847G, A12159G, T27221C, C23054T, A23056C, C23057A, C23059G.

In some embodiments, an isolated nucleic acid molecule of the present invention may further comprise one or more synonymous nucleotide substitution(s), e.g., for use of identifying the recombinant nucleic acid molecule, resultant recombinant protein, and/or resultant recombinant virus particle as compared to a wildtype (WT) viral nucleic acid, protein, and/or virus particle. In some embodiments, an isolated nucleic acid molecule of the present invention may further comprise one or more synonymous nucleotide substitution(s) including, but not limited to, U568C, C1348U, C11758T, T15102A, A12949G, A13003G, A13015G, A13024G, A23914G, C26133U, C26256U, U27210C, G28423A, and/or C28948U. In some embodiments, an isolated nucleic acid molecule of the present invention may further comprise the synonymous nucleotide substitution T15102A.

In some embodiments, an isolated nucleic acid molecule of the present invention may comprise, consist essentially of, or consist of the nucleotide sequence of SEQ ID NO:8 (2019-nCoV/USA-WA1-A12/2020 MA10) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:9 (Passage 10 plaque 1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:10 (Passage 10 plaque 2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:11 (Passage 10 plaque 3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:12 (Passage 10 plaque 4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:15 (MA strain; GenBank MT844088) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:16 (MA10.1.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:17 (MA10.1.2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:18 (MA10.1.3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:19

(MA10.1.4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:20 (MA10.1.5) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:21 (MA10.2.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:22 (MA10.2.2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:23 (MA10.2.3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:24 (MA10.2.4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:25 (MA10.2.5) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:26 (MA10.3.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:26 (MA10.3.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:27 (MA10.3.2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:28 (MA10.3.3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:29 (MA10.3.4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:30 (MA10) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:31 (MA10.4.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:32 (MA10.4.2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:33 (MA10.4.3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:34 (MA10.4.4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:35 (MA10.4.5) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:36 (MA10.5.1) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:37 (MA10.5.2) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:38 (MA10.5.3) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:39 (MA10.5.4) or a sequence at least about 70% identical thereto, e.g., at least about 70, 75, 80, 85, 90, 91, 92, 93, 94, 95, 96, 97, 98, or 99% identical thereto.

In some embodiments, an isolated nucleic acid molecule of the present invention may comprise, consist essentially of, or consist of the nucleotide sequence of SEQ ID NO:40 (MA10.5.5) or a sequence at least about 70% identical thereto, e.g., at least about 70, 75, 80, 85, 90, 91, 92, 93, 94, 95, 96, 97, 98, or 99% identical thereto.

Also provided is a vector, plasmid or other nucleic acid construct comprising the isolated nucleic acid molecule of this invention.

A vector can be any suitable means for delivering a polynucleotide to a cell. A vector of this invention can be an expression vector that contains all of the genetic components required for expression of the nucleic acid in cells into which the vector has been introduced, as are well known in the art. The expression vector can be a commercial expression vector or it can be constructed in the laboratory according to standard molecular biology protocols.

The expression vector can comprise viral nucleic acid including, but not limited to, poxvirus, vaccinia virus, adenovirus, retrovirus, alphavirus and/or adeno-associated virus nucleic acid. The nucleic acid molecule or vector of this invention can also be in a liposome or a delivery vehicle, which can be taken up by a cell via receptor-mediated or other type of endocytosis. The nucleic acid molecule of this invention can be in a cell, which can be a cell expressing the nucleic acid whereby a recombinant protein of this invention is produced in the cell (e.g., a host cell). In addition, the vector of this invention can be in a cell, which can be a cell expressing the nucleic acid of the vector whereby a recombinant of this invention is produced in the cell. It is also contemplated that the nucleic acid molecules and/or vectors of this invention can be present in a host organism (e.g., a transgenic organism), which expresses the nucleic acids of this invention and produces a recombinant protein of this invention. In some embodiments, the vector is a plasmid, a viral vector, a bacterial vector, an expression cassette, a transformed cell, or a nanoparticle.

Further provided herein is a Venezuelan equine encephalitis (VEE) replicon particle (VRP) comprising an isolated nucleic acid molecule encoding a recombinant protein of this invention.

In addition, the present invention provides a virus like particle (VLP) comprising a recombinant of any of this invention and a matrix protein of any virus that can form a VLP.

The present invention also provides a coronavirus particle comprising a recombinant protein of this invention.

Also provided is a SARS-CoV-2 virus particle encoded by an isolated nucleic acid molecule of the invention.

Also provided is a cell (e.g., an isolated cell) comprising the vectors, nucleic acid molecules, VLPs, VRPs, and/or coronavirus particles of the invention.

Additionally provided herein is a population of any of the VLPs, VRPs and/or coronavirus particles of this invention, as well as a population of virus particles that are used as viral vectors encoding a recombinant protein of this invention.

The recombinant proteins of this invention can be produced in a eukaryotic cell system for recombination protein production.

The invention also provides immunogenic compositions comprising the cells, vectors, nucleic acid molecules, VLPs, VRPs, coronavirus particles and/or populations of the invention. The composition can further comprise a pharmaceutically acceptable carrier.

By "pharmaceutically acceptable" it is meant a material that is not toxic or otherwise undesirable, i.e., the material may be administered to a subject without causing any undesirable biological effects. For injection, the carrier will typically be a liquid. For other methods of administration (e.g., such as, but not limited to, administration to the mucous membranes of a subject (e.g., via intranasal administration, buccal administration and/or inhalation)), the carrier may be either solid or liquid. For inhalation administration, the carrier will be respirable, and will preferably be in solid or liquid particulate form. The formulations may be conveniently prepared in unit dosage form and may be prepared by any of the methods well known in the art. In some embodiments, that pharmaceutically acceptable carrier can be a sterile solution or composition.

In some embodiments, the present invention provides a pharmaceutical composition comprising a SARS-Cov-2 virus particle, isolated nucleic acid molecule, vector, VRP, VLP, recombinant protein, population and/or composition of the present invention, a pharmaceutically acceptable carrier, and, optionally, other medicinal agents, therapeutic agents, pharmaceutical agents, stabilizing agents, buffers, carriers, adjuvants, diluents, etc., which can be included in the composition singly or in any combination and/or ratio.

Immunogenic compositions comprising a SARS-Cov-2 virus particle, isolated nucleic acid molecule, vector, VRP, VLP, recombinant protein, population and/or composition of the present invention may be formulated by any means known in the art. Such compositions, especially vaccines, are typically prepared as injectables, either as liquid solutions or suspensions. Solid forms suitable for solution in, or suspension in, liquid prior to injection may also be prepared. Lyophilized preparations are also suitable. In some embodiments, a pharmaceutical composition of the present invention may be a vaccine formulation, e.g., may comprise a SARS-Cov-2 virus particle, isolated nucleic acid molecule, vector, VRP, VLP, recombinant protein, population and/or composition of the present invention and adjuvant(s), optionally in a vaccine diluent. The active immunogenic ingredients are often mixed with excipients and/or carriers that are pharmaceutically acceptable and/or compatible with the active ingredient. Suitable excipients include but are not limited to sterile water, saline, dextrose, glycerol, ethanol, or the like and combinations thereof, as well as stabilizers, e.g., HSA or other suitable proteins and reducing sugars. In addition, if desired, the vaccines or immunogenic compositions may contain minor amounts of auxiliary substances such as wetting and/or emulsifying agents, pH buffering agents, and/or adjuvants that enhance the effectiveness of the vaccine or immunogenic composition.

In some embodiments, a pharmaceutical composition comprising a SARS-Cov-2 virus particle, isolated nucleic acid molecule, vector, VRP, VLP, recombinant protein, population and/or composition of the present invention may further comprise additional agents, such as, but not limited to, additional antigen as part of a cocktail in a vaccine, e.g., a multi-component vaccine wherein the vaccine may additionally include peptides, cells, virus, viral peptides, inactivated virus, etc. Thus, in some embodiments, a pharmaceutical composition comprising a SARS-Cov-2 virus particle, isolated nucleic acid molecule, vector, VRP, VLP, recombinant protein, population and/or composition of the present invention, a pharmaceutically acceptable carrier may further comprise additional viral antigen, e.g., SARS-CoV-2 antigen in the form of peptides, peptoids, whole SARS-CoV-2 virus (e.g., live attenuated and/or inactivated virus), and/or SARS-CoV-2 virus-comprising cells (e.g., cells modified to express SARS-CoV-2 viral components, e.g., SARS-CoV-2 viral peptides).

In some embodiments, a pharmaceutical composition comprising a SARS-Cov-2 virus particle, isolated nucleic acid molecule, vector, VRP, VLP, recombinant protein, population and/or composition of the present invention, and a pharmaceutically acceptable carrier may further comprise an adjuvant. As used herein, "suitable adjuvant" describes an adjuvant capable of being combined with a SARS-Cov-2 virus particle, isolated nucleic acid molecule, vector, VRP, VLP, recombinant protein, population and/or composition of the present invention to further enhance an immune response without deleterious effect on the subject or the cell of the subject. In some embodiments, the subject is a mouse.

The adjuvants of the present invention can be in the form of an amino acid sequence, and/or in the form or a nucleic acid encoding an adjuvant. When in the form of a nucleic acid, the adjuvant can be a component of a nucleic acid encoding the polypeptide(s) or fragment(s) or epitope(s) and/or a separate component of the composition comprising the nucleic acid encoding the polypeptide(s) or fragment(s) or epitope(s) of the invention. According to the present invention, the adjuvant can also be an amino acid sequence that is a peptide, a protein fragment or a whole protein that functions as an adjuvant, and/or the adjuvant can be a nucleic acid encoding a peptide, protein fragment or whole protein that functions as an adjuvant. As used herein, "adjuvant" describes a substance, which can be any immunomodulating substance capable of being combined with a composition of the invention to enhance, improve, or otherwise modulate an immune response in a subject.

In further embodiments, the adjuvant can be, but is not limited to, an immunostimulatory cytokine (including, but not limited to, GM/CSF, interleukin-2, interleukin-12, interferon-gamma, interleukin-4, tumor necrosis factor-alpha, interleukin-1, hematopoietic factor flt3L, CD40L, B7.1 co-stimulatory molecules and B7.2 co-stimulatory molecules), SYNTEX adjuvant formulation 1 (SAF-1) composed of 5 percent (wt/vol) squalene (DASF, Parsippany, N.J.), 2.5 percent Pluronic, L121 polymer (Aldrich Chemical, Milwaukee), and 0.2 percent polysorbate (Tween 80, Sigma) in phosphate-buffered saline. Suitable adjuvants also include an aluminum salt such as aluminum hydroxide gel (alum), aluminum phosphate, or algannmulin, but may also be a salt of calcium, iron or zinc, or may be an insoluble suspension of acylated tyrosine, or acylated sugars, cationically or anionically derivatized polysaccharides, or polyphosphazenes.

Other adjuvants are well known in the art and include without limitation MF 59, LT-K63, LT-R72 (Pal et al. Vaccine 24(6):766-75 (2005)), QS-21, Freund's adjuvant (complete and incomplete), aluminum hydroxide, N-acetyl-muramyl-L-threonyl-D-isoglutamine (thr-MDP), N-acetyl-normuramyl-L-alanyl-D-isoglutamine (CGP 11637, referred to as nor-MDP), N-acetylmuramyl-L-alanyl-D-isoglutami-nyl-L-alanine-2-(1'-2'-dipalmitoyl-sn-glycero-3-hydroxy-phosphoryloxy)-ethylamine (CGP 19835A, referred to as MTP-PE) and RIBI, which contains three components extracted from bacteria, monophosphoryl lipid A, trealose dimycolate and cell wall skeleton (MPL+TDM+CWS) in 2% squalene/Tween 80 emulsion.

Additional adjuvants can include, for example, a combination of monophosphoryl lipid A, preferably 3-de-O-acylated monophosphoryl. lipid A (3D-MPL) together with an aluminum salt. An enhanced adjuvant system involves the combination of a monophosphoryl lipid A and a saponin derivative, particularly the combination of QS21 and 3D-MPL as disclosed in PCT publication number WO 94/00153, or a less reactogenic composition where the QS21 is quenched with cholesterol as disclosed in PCT publication number WO 96/33739. A particularly potent adjuvant formulation involving QS21 3D-MPL & tocopherol in an oil in water emulsion is described in PCT publication number WO 95/17210. In addition, the nucleic acid compositions of the invention can include an adjuvant by comprising a nucleotide sequence encoding the antigen and a nucleotide sequence that provides an adjuvant function, such as CpG sequences. Such CpG sequences, or motifs, are well known in the art.

Adjuvants can be combined, either with the compositions of this invention or with other vaccine compositions that can be used in combination with the compositions of this invention.

Methods

The nucleic acids, proteins, peptides, viruses, vectors, particles, antibodies, VLPs, VRPs, populations, and/or compositions of this invention are intended for use as research agents and immunological reagents, for example, as antigens, immunogens, vaccines, and/or nucleic acid delivery vehicles, for research purposes in mice. The compositions described herein can be formulated for use as reagents (e.g., to produce antibodies) and/or for administration in a pharmaceutical carrier in accordance with known techniques. See, e.g., Remington, *The Science and Practice of Pharmacy* (latest edition).

In one aspect, the present invention provides a method of producing an immune response to a coronavirus in a subject, comprising administering to the subject an effective amount of a recombinant SARS-CoV-2 virus particle, recombinant protein, nucleic acid molecule, vector, VRP, VLP, population and/or composition of the present invention, in any combination, thereby producing an immune response to a coronavirus in the subject.

A recombinant SARS-CoV-2 virus particle, recombinant protein, nucleic acid molecule, vector, VRP, VLP, population and/or composition of the present invention may be administered in any frequency, amount, and/or route as needed to elicit an effective prophylactic and/or therapeutic effect in a subject as described herein. In certain embodiments, a recombinant SARS-CoV-2 virus particle, recombinant protein, nucleic acid molecule, vector, VRP, VLP, population and/or composition of the present invention is administered/delivered to the subject, e.g., systemically (e.g., intravenously). In particular embodiments, more than one administration (e.g., two, three, four or more administrations) may be employed to achieve the desired level of viral and/or protein expression over a period of various intervals, e.g., daily, weekly, monthly, yearly, etc. The most suitable route in any given case will depend on the nature and severity of the condition being studied and on the nature of the particular delivery method that is being used. In embodiments wherein a vector is used, the vector will typically be administered in a liquid formulation by direct injection (e.g., stereotactic injection) to the desired region or tissues. In some embodiments, the vector can be delivered via a reservoir and/or pump. In other embodiments, the vector may be provided by topical application to the desired region or by intra-nasal administration of an aerosol formulation. Administration to the eye or into the ear, may be by topical application of liquid droplets. As a further alternative, the vector may be administered as a solid, slow-release formulation. For example, controlled release of parvovirus and AAV vectors is described in international patent publication WO 01/91803, which is incorporated by reference herein for these teachings.

Administration may be by any suitable means, such as intraperitoneally, intramuscularly, intranasally, intravenously, intradermally (e.g., by a gene gun), intrarectally and/or subcutaneously. The compositions herein may be administered via a skin scarification method, and/or transdermally via a patch or liquid. The compositions can be delivered subdermally in the form of a biodegradable material that releases the compositions over a period of time. As further non-limiting examples, the route of administration can be by inhalation (e.g., oral and/or nasal inhalation), oral, buccal (e.g., sublingual), rectal, vaginal, topical (including administration to the airways), intraocular, by parenteral (e.g., intramuscular [e.g., administration to skeletal muscle], intravenous, intra-arterial, intraperitoneal and the like), subcutaneous (including administration into the footpad), intrapleural, intracerebral, intrathecal, intraventricular, intra-aural, intra-ocular (e.g., intra-vitreous, sub-retinal, anterior chamber) and peri-ocular (e.g., sub-Tenon's region) routes or any combination thereof.

In some embodiments, a recombinant SARS-CoV-2 virus particle or recombinant protein can be administered to a subject as a nucleic acid molecule, which can be a naked nucleic acid molecule or a nucleic acid molecule present in a vector (e.g., a delivery vector, which in some embodiments can be a viral vector, such as a VRP). The nucleic acids and vectors of this invention can be administered orally, intranasally, parenterally (e.g., intravenously), by intramuscular injection, by intraperitoneal injection, transdermally, extracorporeally, topically or the like. In the methods described herein which include the administration and uptake of exogenous DNA into the cells of a subject (i.e., gene transduction or transfection), the nucleic acids of the present invention can be in the form of naked DNA or the nucleic acids can be in a vector for delivering the nucleic acids to the cells for expression of the polypeptides and/or fragments of this invention. The vector can be a commercially available preparation or can be constructed in the laboratory according to methods well known in the art.

Delivery of the nucleic acid or vector to cells can be via a variety of mechanisms, including but not limited to recombinant vectors including bacterial, viral, and fungal vectors, liposomal delivery agents, nanoparticles, and gene gun related mechanisms.

In some embodiments, the nucleic acid molecules encoding the recombinant virus particle and/or recombinant proteins of this invention can be part of a recombinant nucleic acid construct comprising any combination of restriction sites and/or functional elements as are well known in the art that facilitate molecular cloning and other recombinant nucleic acid manipulations. Thus, the present invention further provides a recombinant nucleic acid construct comprising a nucleic acid molecule encoding a recombinant coronavirus particle and/or recombinant protein of this invention. The nucleic acid molecule encoding the recombinant coronavirus particle and/or recombinant protein of this invention can be any nucleic acid molecule that functionally encodes the recombinant coronavirus particle and/or recombinant protein of this invention. To functionally encode the recombinant coronavirus particle and/or recombinant protein (i.e., allow the nucleic acids to be expressed), the nucleic acid of this invention can include, for example, expression control sequences, such as an origin of replication, a promoter, an enhancer and necessary information processing sites, such as ribosome binding sites, RNA splice sites, polyadenylation sites and transcriptional terminator sequences.

Non-limiting examples of expression control sequences that can be present in a nucleic acid molecule of this invention include promoters derived from metallothionine genes, actin genes, immunoglobulin genes, CMV, SV40, adenovirus, bovine papilloma virus, etc. A nucleic acid molecule encoding a selected recombinant protein of the invention can readily be determined based upon the genetic code for the amino acid sequence of the selected polypeptide and/or fragment of interest included in the recombinant protein, and many nucleic acids will encode any selected polypeptide and/or fragment. Modifications in the nucleic acid sequence encoding the polypeptide and/or fragment are also contemplated. Modifications that can be useful are modifications to the sequences controlling expression of the polypeptide and/or fragment to make production of the polypeptide and/or fragment inducible or repressible as controlled by the appropriate inducer or repressor. Such methods are standard in the art. The nucleic acid molecule and/or vector of this invention can be generated by means standard in the art, such as by recombinant nucleic acid techniques and/or by synthetic nucleic acid synthesis or in vitro enzymatic synthesis.

The nucleic acids and/or vectors of this invention can be transferred into a host cell (e.g., a prokaryotic or eukaryotic cell) by well-known methods, which vary depending on the type of cell host. For example, calcium chloride transfection is commonly used for prokaryotic cells, whereas calcium phosphate treatment, transduction, cationic lipid treatment and/or electroporation can be used for other cell hosts.

As another example, delivery can be via a liposome, using commercially available liposome preparations such as LIPOFECTIN, LIPOFECTAMINE (GIBCO-BRL, Inc., Gaithersburg, Md.), SUPERFECT (Qiagen, Inc. Hilden, Germany) and TRANSFECTAM (Promega, Madison, Wis.), as well as other liposomes developed according to procedures standard in the art. In addition, the nucleic acid or vector of this invention can be delivered in vivo by electroporation, the technology for which is available from Genetronics, Inc. (San Diego, Calif.) as well as by means of a SONOPORATION machine (ImaRx Pharmaceutical Corp., Tucson, Ariz.).

As another example, vector delivery can be via a viral system, such as a retroviral vector system, which can package a recombinant retroviral genome. The recombinant retrovirus can then be used to infect and thereby deliver to the infected cells nucleic acid encoding the polypeptide and/or fragment of this invention. The exact method of introducing the exogenous nucleic acid into mammalian cells is, of course, not limited to the use of retroviral vectors. Other techniques are widely available for this procedure including the use of adenoviral vectors, alphaviral vectors (e.g., VRPs), adeno-associated viral (AAV) vectors, lentiviral vectors, pseudotyped retroviral vectors and vaccinia viral vectors, as well as any other viral vectors now known or developed in the future. Physical transduction techniques can also be used, such as liposome delivery and receptor-mediated and other endocytosis mechanisms. This invention can be used in conjunction with any of these or other commonly used gene transfer methods.

If ex vivo methods are employed, cells or tissues can be removed and maintained outside the body according to standard protocols well known in the art. The nucleic acids and vectors of this invention can be introduced into the cells via any gene transfer mechanism, such as, for example, virus-mediated gene delivery, calcium phosphate mediated gene delivery, electroporation, microinjection or proteoliposomes. The transduced cells can then be infused (e.g., in a pharmaceutically acceptable carrier) or transplanted back into the subject per standard methods for the cell or tissue type. Standard methods are known for transplantation or infusion of various cells into a subject.

Parenteral administration of the peptides, polypeptides, nucleic acids and/or vectors of the present invention, if used, is generally characterized by injection. Injectables can be prepared in conventional forms, either as liquid solutions or suspensions, solid forms suitable for solution of suspension in liquid prior to injection, or as emulsions. As used herein, "parenteral administration" includes intradermal, intranasal, subcutaneous, intramuscular, intraperitoneal, intravenous and intratracheal routes, as well as a slow release or sustained release system such that a constant dosage is maintained. See, e.g., U.S. Pat. No. 3,610,795, which is incorporated by reference herein in its entirety.

In some embodiments, the compositions of the invention can be administered with and/or further comprise one or more than one adjuvant. The adjuvants of the present invention can be in the form of an amino acid sequence, and/or in the form or a nucleic acid encoding an adjuvant. When in the form of a nucleic acid, the adjuvant can be a component of a nucleic acid encoding the polypeptide(s) or fragment(s) or epitope(s) and/or a separate component of the composition comprising the nucleic acid encoding the polypeptide(s) or fragment(s) or epitope(s) of the invention. According to the present invention, the adjuvant can also be an amino acid sequence that is a peptide, a protein fragment or a whole protein that functions as an adjuvant, and/or the adjuvant can be a nucleic acid encoding a peptide, protein fragment or whole protein that functions as an adjuvant. As used herein, "adjuvant" describes a substance, which can be any immunomodulating substance capable of being combined with a composition of the invention to enhance, improve, or otherwise modulate an immune response in a subject.

An adjuvant for use with the present invention, such as, for example, an immunostimulatory cytokine, can be administered before, concurrent with, and/or within a few hours, several hours, and/or 1, 2, 3, 4, 5, 6, 7, 8, 9, and/or 10 days before and/or after the administration of a composition of the invention to a subject.

In some embodiments, the methods of the present invention may further comprise administering a recombinant coronavirus particle, recombinant protein, nucleic acid molecule, vector, VRP, VLP, population and/or composition of the present invention, a pharmaceutically acceptable carrier, and, optionally, other medicinal agents, therapeutic agents, pharmaceutical agents, stabilizing agents, buffers, carriers, adjuvants, diluents, etc. In some embodiments, the methods of the present invention may further comprise administering additional agent(s) such as, but not limited to, additional antigen as part of a cocktail in a vaccine, e.g., a multicomponent cocktail vaccine wherein the vaccine may additionally include peptides, cells, virus, viral peptides, inactivated virus, etc. Thus, in some embodiments, the methods of the present invention may further comprise administering additional viral antigen, e.g., coronavirus antigen in the form of peptides, peptoids, whole virus (e.g., live attenuated and/or inactivated virus), and/or virus-comprising cells (e.g., cells modified to express viral components, e.g., viral peptides).

Injectables can be prepared in conventional forms, either as liquid solutions or suspensions, solid forms suitable for solution or suspension in liquid prior to injection, or as emulsions. Alternatively, one may administer the vector in a local rather than systemic manner, for example, in a depot or sustained-release formulation. Further, the virus vector can be delivered dried to a surgically implantable matrix such as a bone graft substitute, a suture, a stent, and the like (e.g., as described in U.S. Pat. No. 7,201,898).

Pharmaceutical compositions suitable for oral administration can be presented in discrete units, such as capsules, cachets, lozenges, or tablets, each containing a predetermined amount of the composition of this invention; as a powder or granules; as a solution or a suspension in an aqueous or non-aqueous liquid; or as an oil-in-water or water-in-oil emulsion. Oral delivery can be performed by complexing a vector of the present invention to a carrier capable of withstanding degradation by digestive enzymes in the gut of an animal. Examples of such carriers include plastic capsules or tablets, as known in the art. Such formulations are prepared by any suitable method of pharmacy, which includes the step of bringing into association the composition and a suitable carrier (which may contain one or more accessory ingredients as noted above). In general, the pharmaceutical composition according to embodiments of the present invention are prepared by uniformly and intimately admixing the composition with a liquid or finely divided solid carrier, or both, and then, if necessary, shaping the resulting mixture. For example, a tablet can be prepared by compressing or molding a powder or granules containing the composition, optionally with one or more accessory ingredients. Compressed tablets are prepared by compressing, in a suitable machine, the composition in a free-flowing form, such as a powder or granules optionally mixed with a binder, lubricant, inert diluent, and/or surface active/dispersing agent(s). Molded tablets are made by molding, in a suitable machine, the powdered compound moistened with an inert liquid binder.

Pharmaceutical compositions suitable for buccal (sublingual) administration include lozenges comprising the composition of this invention in a flavored base, usually sucrose and acacia or tragacanth; and pastilles comprising the composition in an inert base such as gelatin and glycerin or sucrose and acacia.

Pharmaceutical compositions suitable for parenteral administration can comprise sterile aqueous and non-aqueous injection solutions of the composition of this invention, which preparations are optionally isotonic with the blood of the intended recipient. These preparations can contain antioxidants, buffers, bacteriostats and solutes, which render the composition isotonic with the blood of the intended recipient. Aqueous and non-aqueous sterile suspensions, solutions and emulsions can include suspending agents and thickening agents. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions, or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, and inert gases and the like.

The compositions can be presented in unit/dose or multidose containers, for example, in sealed ampoules and vials, and can be stored in a freeze-dried (lyophilized) condition requiring only the addition of the sterile liquid carrier, for example, saline or water-for-injection immediately prior to use.

Extemporaneous injection solutions and suspensions can be prepared from sterile powders, granules and tablets of the kind previously described. For example, an injectable, stable, sterile composition of this invention in a unit dosage form in a sealed container can be provided. The composition can be provided in the form of a lyophilizate, which can be reconstituted with a suitable pharmaceutically acceptable carrier to form a liquid composition suitable for injection into a subject. The unit dosage form can be from about 1 µg to about 10 grams of the composition of this invention. When the composition is substantially water-insoluble, a sufficient amount of emulsifying agent, which is physiologically acceptable, can be included in sufficient quantity to emulsify the composition in an aqueous carrier. One such useful emulsifying agent is phosphatidyl choline.

The pharmaceutical compositions of this invention include those suitable for oral, rectal, topical, inhalation (e.g., via an aerosol) buccal (e.g., sub-lingual), vaginal, parenteral (e.g., subcutaneous, intramuscular, intradermal, intraarticular, intrapleural, intraperitoneal, intracerebral, intraarterial, or intravenous), topical (i.e., both skin and mucosal surfaces, including airway surfaces) and transdermal administration. The compositions herein may also be administered via a skin scarification method, or transdermally via a patch or liquid. The compositions may be delivered subdermally in the form of a biodegradable material that releases the compositions over a period of time. The most suitable route in any given case will depend, as is well known in the art, on such factors as the species, age, gender and overall condition of the subject, the nature and severity of the condition being treated and/or on the nature of the particular composition (i.e., dosage, formulation) that is being administered.

Pharmaceutical compositions suitable for rectal administration can be presented as unit dose suppositories. These can be prepared by admixing the composition with one or more conventional solid carriers, such as for example, cocoa butter, and then shaping the resulting mixture.

Pharmaceutical compositions of this invention suitable for topical application to the skin can take the form of an ointment, cream, lotion, paste, gel, spray, aerosol, or oil. Carriers that can be used include, but are not limited to, petroleum jelly, lanoline, polyethylene glycols, alcohols, transdermal enhancers, and combinations of two or more thereof. In some embodiments, for example, topical delivery can be performed by mixing a pharmaceutical composition of the present invention with a lipophilic reagent (e.g., DMSO) that is capable of passing into the skin.

Pharmaceutical compositions suitable for transdermal administration can be in the form of discrete patches adapted to remain in intimate contact with the epidermis of the subject for a prolonged period of time. Compositions suitable for transdermal administration can also be delivered by iontophoresis (see, for example, *Pharm. Res.* 3:318 (1986)) and typically take the form of an optionally buffered aqueous solution of the composition of this invention. Suitable formulations can comprise citrate or bis\tris buffer (pH 6) or ethanol/water and can contain from 0.1 to 0.2M active ingredient.

The delivery methods disclosed herein may be administered to the lungs of a subject by any suitable means, for example, by administering an aerosol suspension of respirable particles comprised of the vectors, which the subject inhales. The respirable particles may be liquid or solid. Aerosols of liquid particles comprising the virus vectors may be produced by any suitable means, such as with a pressure-driven aerosol nebulizer or an ultrasonic nebulizer, as is known to those of skill in the art. See, e.g., U.S. Pat. No. 4,501,729. Aerosols of solid particles comprising the vectors may likewise be produced with any solid particulate medicament aerosol generator, by techniques known in the pharmaceutical art.

The compositions of this invention can be optimized and combined with other vaccination regimens to provide the broadest (i.e., covering all aspects of the immune response, including those features described hereinabove) cellular and humoral responses possible. In certain embodiments, this can include the use of heterologous prime-boost strategies, in which the compositions of this invention are used in combination with a composition comprising one or more of the following: immunogens derived from a pathogen or tumor, recombinant immunogens, naked nucleic acids, nucleic acids formulated with lipid-containing moieties, and viral vectors (including but not limited to alphavirus vectors, poxvirus vectors, adenoviral vectors, adeno-associated viral vectors, herpes virus vectors, vesicular stomatitis virus vectors, paramyxoviral vectors, parvovirus vectors, papovavirus vectors, retroviral vectors, lentivirus vectors).

A subject of this invention is any animal that is capable of producing an immune response against a coronavirus. A subject of this invention can also be any animal that is susceptible to infection by coronavirus and/or susceptible to diseases or disorders caused by coronavirus infection. A subject of this invention can be a mammal and in particular embodiments is a mouse, which can be a neonate, a youth, an adult, or an older adult. A "subject at risk of infection by a coronavirus" or a "subject at risk of coronavirus infection" is any subject who may be or has been exposed to a coronavirus.

In some embodiments, a recombinant coronavirus particle, recombinant protein, nucleic acid molecule, vector, VRP, VLP, population and/or composition of the present invention may be administered once, twice, three times, four times, five times, six times, seven times, eight times, nine times, ten times or more. In some embodiments, a recombinant coronavirus particle, recombinant protein, nucleic acid molecule, vector, VRP, VLP, population and/or composition of the present invention may be administered, for example, once a day, once every two days, once every three days, once every four days, once every five days, once every six days, once every seven days (once a week), once every two weeks, once every three weeks, once every four weeks, and/or once a month, etc., for multiple repetitions, e.g., twice a day, twice a week, twice a month, three times a day, three times a week, three times a month, etc. for one repetition, for two repetitions, for three repetitions, for four repetitions, for five repetitions, for six repetitions, or more. For example, in some embodiments, a recombinant coronavirus particle, recombinant protein, nucleic acid molecule, vector, VRP, VLP, population and/or composition of the present invention may be administered every two weeks for two, three, or four or more repetitions. In some embodiments, a recombinant coronavirus particle, recombinant protein, nucleic acid molecule, vector, VRP, VLP, population and/or composition of the present invention may be administered every three weeks for two, three, or four or more repetitions. In some embodiments, a recombinant coronavirus particle, recombinant protein, nucleic acid molecule, vector, VRP, VLP, population and/or composition of the present invention may be administered every four weeks for two, three, or four or more repetitions.

In some embodiments, a recombinant coronavirus particle, recombinant protein, nucleic acid molecule, vector, VRP, VLP, population and/or composition of the present invention may be administered in a therapeutically effective amount. In some embodiments, a recombinant coronavirus particle, recombinant protein, nucleic acid molecule, vector, VRP, VLP, population and/or composition of the present invention may be administered in an amount of about 0.5 µg to about 250 µg or any value or range therein, e.g., about 1 µg, about 2 µg, about 3 µg, about 4 µg, about 5 µg, about 6

μg, about 7 μg, about 8 μg, about 9 μg, about 10 μg, about 11 μg, about 12 μg, about 13 μg, about 14 μg, about 15 μg, about 16 μg, about 17 μg, about 18 μg, about 19 μg, about 20 μg, about 25 μg, about 30 μg, about 35 μg, about 40 μg, about 45 μg, about 50 μg, about 55 μg, about 60 μg, about 65 μg, about 70 μg, about 75 μg, about 80 μg, about 85 μg, about 90 μg, about 95 μg, about 100 μg, about 110 μg, about 120 μg, about 130 μg, about 140 μg, about 150 μg, about 160 μg, about 170 μg, about 180 μg, about 190 μg, about 200 μg, about 210 μg, about 220 μg, about 230 μg, about 240 μg, about 250 μg or any value or range therein. For example in some embodiments, a recombinant coronavirus particle, recombinant protein, nucleic acid molecule, vector, VRP, VLP, population and/or composition of the present invention may be administered in an amount of about 1 μg, about 5 μg, about 10 μg, about 75 μg, about 100 μg, about 150 μg, about 250 μg, or about 0.5 pg to about 15 μg, about 1 pg to about 200 μg, about 5 pg to about 250 μg, or about 2.5 pg to about 115 pg.

A nonlimiting example of an effective amount of a virus or virus particle (e.g., VRP) of this invention is from about $10^4$ to about $10^{10}$, preferably from about $10^5$ to about $10^9$, and in particular from about $10^6$ to about $10^8$ infectious units (IU, as measured by indirect immunofluorescence assay), or virus particles, per dose, which can be administered to a subject, depending upon the age, species and/or condition of the subject being treated. For subunit vaccines (e.g., purified antigens) a dose range of from about 1 to about 100 micrograms can be used. As would be well known to one of ordinary skill in the art, the optimal dosage would need to be determined for any given antigen or vaccine, e.g., according to the method of production and resulting immune response.

The exact amount of the nucleic acid or vector required will vary from subject to subject, depending on the species, age, weight and general condition of the subject, the particular nucleic acid or vector used, its mode of administration and the like. Thus, it is not possible to specify an exact amount for every nucleic acid or vector. However, an appropriate amount can be determined by one of ordinary skill in the art using only routine experimentation given the teachings herein.

For administration of serum or antibodies, as one nonlimiting example, a dosage range of from about 20 to about 40 international Units/Kilogram can be used, although it would be well understood that optimal dosage for administration to a subject of this invention needs to be determined, e.g., according to the method of production and resulting immune response.

In some embodiments, VEE replicon vectors can be used to express coronavirus structural genes in producing combination vaccines. Dendritic cells, which are professional antigen-presenting cells and potent inducers of T-cell responses to viral antigens, are preferred targets of VEE and VEE replicon particle infection, while SARS coronavirus targets the mucosal surfaces of the respiratory and gastrointestinal tract. As the VEE and coronavirus replicon RNAs synergistically interact, two-vector vaccine systems are feasible that may result in increased immunogenicity when compared with either vector alone. Combination prime-boost vaccines (e.g., DNA immunization and vaccinia virus vectors) have dramatically enhanced the immune response (notably cellular responses) against target papillomavirus and lentivirus antigens compared to single-immunization regimens (Chen et al. (2000) *Vaccine* 18:2015-2022; Gonzalo et al. (1999) *Vaccine* 17:887-892; Hanke et al. (1998) *Vaccine* 16:439-445; Pancholi et al. (2000) *J. Infect. Dis.* 182:18-27). Using different recombinant viral vectors (influenza and vaccinia) to prime and boost may also synergistically enhance the immune response, sometimes by an order of magnitude or more (Gonzalo, et al. (1999) *Vaccine* 17:887-892). Thus, the present invention also provides methods of combining different recombinant viral vectors (e.g., VEE and coronavirus) in prime boost protocols.

Another aspect of the present invention provides immunoassays comprising a recombinant coronavirus particle, recombinant protein, nucleic acid molecule, vector, VRP, VLP, population and/or composition of the present invention.

In some embodiments, the present invention provides a method of identifying an agent effective in inhibiting coronavirus replication, the method comprising: (a) contacting a sample comprising the agent with the virus particle of the present invention wherein the virus particle comprises the nLUC luminescence reporter sequence substituted in place of wildtype ORF7 under conditions whereby viral replication can occur; (b) measuring the amount of luminescence in the sample; and (c) comparing the amount of luminescence in the sample to the level of luminescence in a control sample contacted with the virus particle of step (a) under conditions whereby viral replication occurs uninhibited, wherein a lesser or reduced amount of luminescence in the sample as compared to the control sample indicates inhibition of viral replication, thereby identifying an agent effective in inhibiting coronavirus replication.

In some embodiments, the method comprises performing step (a) in serial dilutions.

In some embodiments, the sample may be a serum sample (e.g., a serum sample from a mouse; e.g., a serum sample from a human subject).

In some embodiments, the sample may be a cell (e.g., a cell isolated from or within a mouse; e.g., a cell isolated from or within a human subject).

In some embodiments, a sample of the present invention may comprise a known agent to be tested, e.g., wherein a known agent is comprised within the sample or has been added exogenously to the sample in order to determine and/or measure potential antiviral activity (replication inhibitory function) by the known agent.

In some embodiments, a sample of the present invention may comprise an unknown agent, e.g., wherein the sample is a sample of interest to be tested for detection and/or identification of an unknown component comprised within the sample which may have antiviral activity (replication inhibitory function), e.g., screening said sample for antiviral function.

In some embodiments, virus particles and/or proteins can be conjugated or otherwise linked or connected (e.g., covalently or noncovalently) to a solid support (e.g., bead, plate, slide, dish, membrane or well) in accordance with known techniques. Antibodies can also be conjugated or otherwise linked or connected to detectable groups such as radiolabels (e.g., $^{35}S$, $^{125}I$, $^{32}P$, $^{13}H$ $^{14}C$, $^{13}I$), enzyme labels (e.g., horseradish peroxidase, alkaline phosphatase), gold beads, chemiluminescence labels, ligands (e.g., biotin) and/or fluorescence labels (e.g., fluorescein) in accordance with known techniques.

A variety of organic and inorganic polymers, both natural and synthetic can be used as the material for the solid surface. Nonlimiting examples of polymers include polyethylene, polypropylene, poly(4-methylbutene), polystyrene, polymethacrylate, poly(ethylene terephthalate), rayon, nylon, poly(vinyl butyrate), polyvinylidene difluoride (PVDF), silicones, polyformaldehyde, cellulose, cellulose acetate, nitrocellulose, and the like. Other materials that can be used include, but are not limited to, paper, glass, ceramic, metal, metalloids, semiconductive materials, cements, and the like. In addition, substances that form gels, such as proteins (e.g., gelatins), lipopolysaccharides, silicates, agarose, and polyacrylamides can be used. Polymers that form several aqueous phases, such as dextrans, polyalkylene glycols or surfactants, such as phospholipids, long chain (12-24 carbon atoms) alkyl ammonium salts and the like are also suitable. Where the solid surface is porous, various pore sizes can be employed depending upon the nature of the system.

A variety of immunoassay systems can be used with a recombinant coronavirus particle, recombinant protein, nucleic acid molecule, vector, VRP, VLP, population and/or composition of the present invention, including but not limited to, radio-immunoassays (RIA), enzyme-linked immunosorbent assays (ELISA) assays, enzyme immunoassays (EIA), "sandwich" assays, gel diffusion precipitation reactions, immunodiffusion assays, agglutination assays, immunofluorescence assays, fluorescence activated cell sorting (FACS) assays, immunohistochemical assays, protein A immunoassays, protein G immunoassays, protein L immunoassays, biotin/avidin assays, biotin/streptavidin assays, immunoelectrophoresis assays, precipitation/flocculation reactions, immunoblots (Western blot; dot/slot blot); immunodiffusion assays; liposome immunoassay, chemiluminescence assays, library screens, expression arrays, immunoprecipitation, competitive binding assays and immunohistochemical staining. These and other assays are described, among other places, in Hampton et al. (*Serological Methods, a Laboratory Manual*, APS Press, St Paul, Minn. (1990)) and Maddox et al. (*J. Exp. Med.* 158:1211-1216 (1993); the entire contents of which are incorporated herein by reference for teachings directed to immunoassays).

The methods of this invention can also be carried out using a variety of solid phase systems, such as described in U.S. Pat. No. 5,879,881, as well as in a dry strip lateral flow system (e.g., a "dipstick" system), such as described, for example, in U.S. Patent Publication No. 20030073147, the entire contents of each of which are incorporated by reference herein.

Embodiments of the present invention include monoclonal antibodies produced from B cells isolated from a subject of this invention that has produced an immune response against a recombinant coronavirus particle, recombinant protein, nucleic acid molecule, vector, VRP, VLP, population and/or composition of the present invention, wherein said monoclonal antibodies are specific to epitopes present on the recombinant coronavirus particle and/or recombinant protein.

The term "antibody" or "antibodies" as used herein refers to all types of immunoglobulins, including IgG, IgM, IgA, IgD, and IgE. The antibody can be monoclonal or polyclonal and can be of any species of origin, including, for example, mouse, rat, rabbit, horse, goat, sheep or human, or can be a chimeric or humanized antibody. See, e.g., Walker et al., *Molec. Immunol.* 26:403-11 (1989). The antibodies can be recombinant monoclonal antibodies produced according to the methods disclosed in U.S. Pat. Nos. 4,474,893 or 4,816,567. The antibodies can also be chemically constructed according to the method disclosed in U.S. Pat. No. 4,676,980. The antibody can further be a single chain antibody or bispecific antibody. The antibody can also be humanized for administration to a human subject.

Antibody fragments included within the scope of the present invention include, for example, Fab, F(ab')2, and Fc fragments, and the corresponding fragments obtained from antibodies other than IgG. Such fragments can be produced by known techniques. For example, F(ab')2 fragments can be produced by pepsin digestion of the antibody molecule, and Fab fragments can be generated by reducing the disulfide bridges of the F(ab')2 fragments. Alternatively, Fab expression libraries can be constructed to allow rapid and easy identification of monoclonal Fab fragments with the desired specificity (Huse et al., (1989) *Science* 254:1275-1281).

Monoclonal antibodies can be produced in a hybridoma cell line according to the technique of Kohler and Milstein, (1975) *Nature* 265:495-97. For example, a solution containing the appropriate antigen can be injected into a mouse and, after a sufficient time, the mouse sacrificed and spleen cells obtained. The spleen cells are then immortalized by fusing them with myeloma cells or with lymphoma cells, typically in the presence of polyethylene glycol, to produce hybridoma cells. The hybridoma cells are then grown in a suitable medium and the supernatant screened for monoclonal antibodies having the desired specificity. Monoclonal Fab fragments can be produced in bacterial cell such as *E. coli* by recombinant techniques known to those skilled in the art. See, e.g., W. Huse, (1989) *Science* 246:1275-81.

Antibodies can also be obtained by phage display techniques known in the art or by immunizing a heterologous host with a cell containing an epitope of interest.

In the manufacture of a pharmaceutical composition according to embodiments of the present invention, the composition of this invention is typically admixed with, inter alia, a pharmaceutically acceptable carrier. By "pharmaceutically acceptable carrier" is meant a carrier that is compatible with other ingredients in the pharmaceutical composition and that is not harmful or deleterious to the subject. A "pharmaceutically acceptable" component such as a salt, carrier, excipient or diluent of a composition according to the present invention is a component that (i) is compatible with the other ingredients of the composition in that it can be combined with the compositions of the present invention without rendering the composition unsuitable for its intended purpose, and (ii) is suitable for use with subjects as provided herein without undue adverse side effects (such as toxicity, irritation, and allergic response). Side effects are "undue" when their risk outweighs the benefit provided by the composition. Non-limiting examples of pharmaceutically acceptable components include, without limitation, any of the standard pharmaceutical carriers such as phosphate buffered saline solutions, water, emulsions such as oil/water emulsion, microemulsions and various types of wetting agents. A pharmaceutically acceptable carrier can comprise, consist essentially of or consist of one or more synthetic components (e.g., components that do not naturally occur in nature), as are known in the art.

The carrier may be a solid or a liquid, or both, and is preferably formulated with the composition of this invention as a unit-dose formulation. The pharmaceutical compositions are prepared by any of the well-known techniques of pharmacy including, but not limited to, admixing the components, optionally including one or more accessory ingredients. Exemplary pharmaceutically acceptable carriers include, but are not limited to, sterile pyrogen-free water and sterile pyrogen-free physiological saline solution. Such carriers can further include protein (e.g., serum albumin) and sugar (sucrose, sorbitol, glucose, etc.).

The invention will now be described with reference to the following examples. It should be appreciated that these examples are not intended to limit the scope of the claims to the invention but are rather intended to be exemplary of certain embodiments. Any variations in the exemplified methods that occur to the skilled artisan are intended to fall within the scope of the invention.

EXAMPLES

The foregoing is illustrative of the present invention, and is not to be construed as limiting thereof. The invention is defined by the following claims, with equivalents of the claims to be included therein.

Example 1: A Mouse-Adapted SARS-CoV-2 Model for the Evaluation of COVID-19 Medical Countermeasures To determine the utility of hACE2 transgenic mice as a model for SARS-CoV-2 disease, we infected epithelial cell-specific HFH4 promoter driven hACE2-overexpressing mice with SARS-CoV-25. hACE2 mice lost minimal weight yet only 60% survived by 5 days post infection (dpi). Similar to previously reported SARS-CoV-1 infection of hACE2 mice, SARS-CoV-2 replication was detected in the brains of those that succumbed to infection suggesting that mortality was driven by viral neuroinvasion. Lastly, whole body plethysmography (WBP) reveals pulmonary function remained at normal levels for the duration of these studies proving further evidence that respiratory infection was likely not a major driver of mortality. Thus, in the presence of a hACE2 transgene, mice fully support SARS-CoV-2 replication but the observed pathogenesis failed to accurately model the disease course seen in humans.

Figures 1A, 1B, 1C:
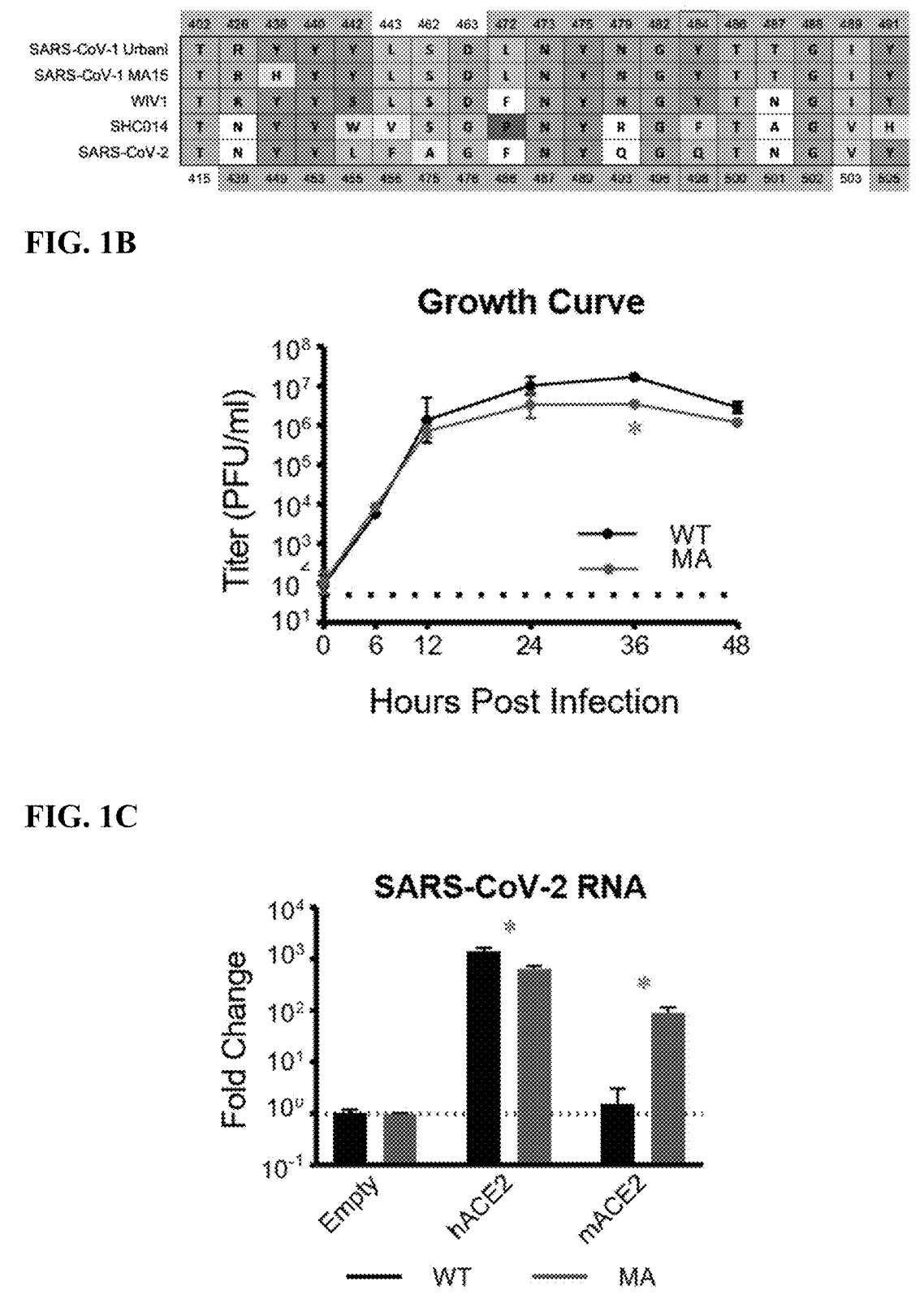

Rather than alter the host, we next sought to remodel the SARS-CoV-2 spike receptor binding domain to facilitate efficient binding to mACE2 and therefore productive viral infection. Upon comparing the ACE2 contact residues in the RBDs of several group 2B coronaviruses capable of infecting mice (SARS-CoV-1, WIV1, and SHC014) to those of SARS-CoV-2, residue 498 of SARS-CoV-2 was uniquely divergent (FIG. 1A). In addition, molecular modeling of the SARS-CoV-2 RBD and receptor interface revealed a loss of interaction between Q498 of the SARS-CoV-2 spike and Q42 of mACE2, which may diminish binding efficiency. Thus, we predicted the substitution of residue Q498, and adjacent P499, with those from WIV1 and SARS-CoV-1 would restore the interaction with Q42 of mACE2, while preserving interaction with hACE2. Using reverse genetics, we engineered Q498Y/P499T into the SARS-CoV-2 S gene and recovered the recombinant virus (SARS-CoV-2 MA; Table 1). Importantly, SARS-CoV-2 MA replicated to similar levels as the parental WT virus in Vero E6 cells (FIG. 1B) and unlike WT virus, SARS-CoV-2 MA could infect cells expressing mACE2 (FIG. 1C).

After demonstrating SARS-CoV-2 MA could utilize mACE2 for entry, we sought to determine if this virus could infect young adult WT mice. While overt clinical signs of infection (e.g., weight loss) were not observed in young adult BALB/c mice infected with $10^5$ PFU SARS-CoV-2 MA (FIG. 2 panel A), high titer virus replication ($6.93 \times 10^5$ PFU/tissue) was noted in lung tissue on 2 dpi but was cleared by 4 dpi (FIG. 2 panel B). Under identical conditions, SARS-CoV-2 did not replicate in mice. Histological analysis of SARS-CoV-2 MA infected mice revealed inflammation of small conducting airways on 2 dpi, associated with high levels of viral antigen staining. Viral replication was limited to conducting airways and absent in interstitium, and is absent on 4 dpi, concordant with clearance of viral titer (FIG. 2 panel B). Similar to that observed in humans, SARS-CoV-2 MA replication was also observed in the upper airway although the magnitude was less than that seen in the lung (FIG. 2 panel C). The loss of pulmonary function as measured by WBP is commonly observed in murine models of emerging CoV pathogenesis and is an important clinically relevant measure of disease. Using WBP, we evaluated several complementary metrics of pulmonary obstruction and bronchoconstriction including PenH and Rpef. Interestingly, SARS-CoV-2 MA young infected mice showed a small but significant change in PenH (FIG. 2 panel D) and a significant decrease in Rpef (FIG. 2 panel E) on 2 dpi indicative of a decrease in lung function. Thus, like often seen in young adult humans, infection of young adult mice with SARS-CoV-2 MA resulted in efficient virus replication in the upper and lower airways, limited replication in the parenchyma and was associated with mild to moderate disease.

Figure 3:
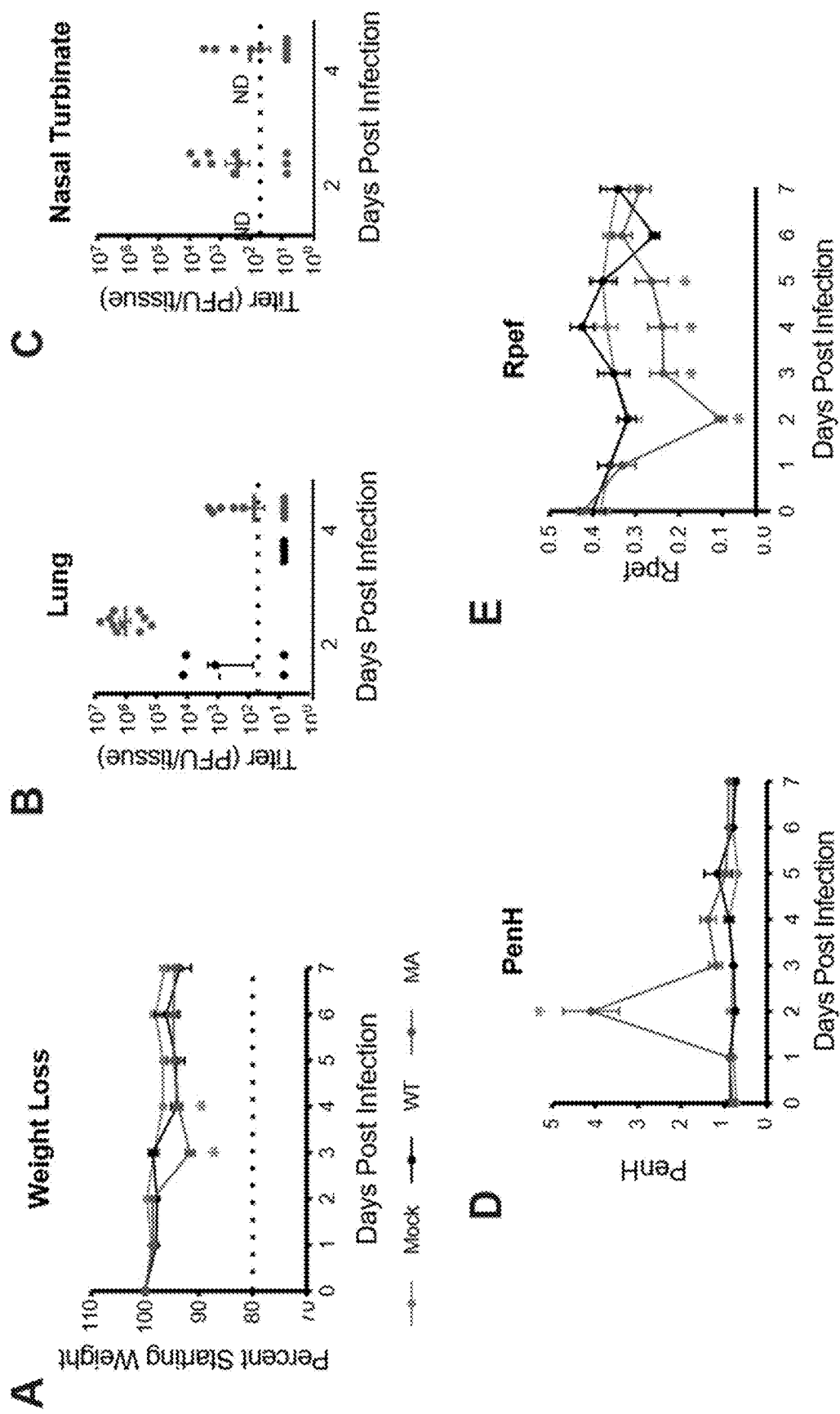
FIG. 3 shows data plots from experiments of SARS-CoV-2 MA replicates in old BALB/c mice with minor disease. 1-year-old female BALB/c were mock infected, or infected with 105 PFU SARS-CoV-2 WT or MA. n=25, 15, 34, respectively. Mice were harvested on day 2, 4 and 7 after infection (n=5-14 per time point). Data combined from two independent experiments.

Higher morbidity and mortality rates have been consistently observed in older human populations throughout the COVID-19 pandemic. Additionally, wildtype and mouse adapted SARS-CoV-1 shows strong age dependent disease phenotypes in humans and mice, respectively. To determine if the age-related increase in pathogenesis observed in SARS-CoV-2 infected humans would translate to infection of aged mice, we infected 12-month-old BALB/c mice with SARS-CoV-2 MA. In contrast to young adult mice, aged BALB/c mice exhibited a transient yet significant decrease in body weight by 3 dpi, which was recovered by 4 dpi (FIG. 3 panel A). Old mice also had high titers at 2 dpi ($1.07 \times 10^6$ PFU/tissue) and detectable virus titers at 4 dpi. Similarly, replication in the upper airway persisted in half of the mice at 4 dpi. Compared to young mice, SARS-CoV-2 MA infected old mice displayed increased inflammation in the lung at 2 dpi and 4 dpi, and viral antigen was found in both conducting airway epithelium and interstitium (FIG. 3 panels B and C). Additionally, at 4 dpi, SARS-CoV-2 MA infection induced hemorrhage and formation of bronchus-associated lymphoid tissue (BALT). Lastly, the loss of pulmonary function was more pronounced in aged animals as evidenced by significant differences in PenH and Rpef among mock and SARS-CoV-2 MA infected animals (FIG. 3 panels D and E).

Figure 4:
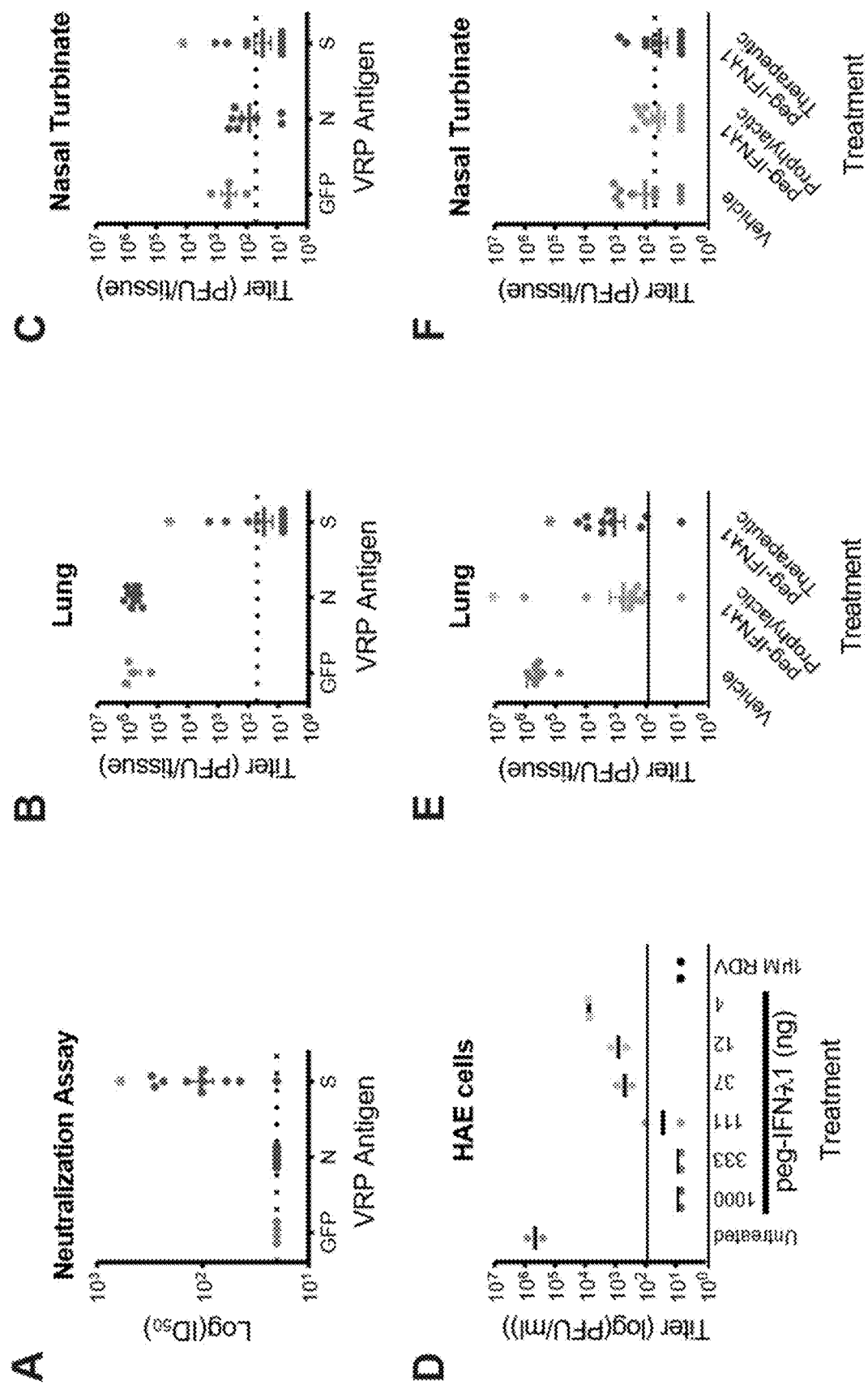
FIG. 4 shows data plots from an evaluation of prevention and intervention strategies against SARS-CoV-2 MA infection in mice.

A replication competent SARS-CoV-2 MA strain promotes in vivo pathogenesis studies, and importantly, allows for rapid testing of intervention strategies in standard laboratory mice during an expanding pandemic. Utilizing a Venezuelan equine encephalitis virus replicon particle (VRP) system, we vaccinated 10-week-old BALB/c mice against SARS-CoV-2 spike (S), nucleocapsid (N), and GFP as a control, boosted after 3 weeks, and challenged 4 weeks post boost with SARS-CoV-2 MA. Serum samples were taken 3 weeks post boost to measure neutralization titers. Unlike mice vaccinated with GFP or N, serum from S vaccinated mice potently neutralized SARS-CoV-2 reporter virus expressing nanoluciferase (nLUC) (FIG. 4 panel A). Upon challenge with SARS-CoV-2 MA, only those vaccinated with VRP expressing S significantly diminished lung and nasal turbinate titer (FIG. 4 panels B and C).

Interferon lambda is a type III interferon whose receptors are largely limited to epithelial cells, including the lungs, liver, and gastrointestinal tract. Treatment with interferons has been employed as pan viral treatment for several viral infections, including trials for the treatment of SARS-CoV-1 and MERS-CoV infections. Pegylated interferon lambda-1 (peg-IFN-$\lambda$1) is Phase 3-ready for hepatitis delta virus infection and has been proposed to treat COVID-19 patients.

We first sought to determine if peg-IFN-λ1 would initiate an antiviral response capable of inhibiting productive infection of primary human airway epithelial (HAE) cell cultures by SARS-CoV-2. Pretreatment of HAE with peg-IFN-λ1 provided a potent dose dependent reduction in SARS-CoV-2 infectious virus production (FIG. 4 panel D). To determine if this in vitro antiviral effect would translate to in vivo efficacy, we performed prophylactic and therapeutic efficacy studies in BALB/c mice. We subcutaneously administered 2 μg peg-IFN-λ1 18 hr prior or 12 hr after infection with $10^5$ PFU SARS-CoV-2 MA. Both prophylactic and therapeutic administration of peg-IFN-λ1 significantly diminished SARS-CoV-2 MA replication in the lung (FIG. 4 panel E). Peg-IFN-λ1 lowered nasal turbinate titer compared to vehicle treated mice, though not statistically significant due likely due to the limit of detection (FIG. 4 panel F). Altogether, these data demonstrate the utility of this model to rapidly evaluate vaccine and therapeutic drug efficacy in standard laboratory mice. In addition, we show that peg-IFN-λ1 exerts potent antiviral activity against SARS-CoV-2 in vitro and can diminish virus replication in vivo even when given therapeutically.

Group 2B coronavirus spike and ACE2 amino acid sequences were aligned using Geneious Prime (Version 2020.0.5). Accession numbers used: SARS-CoV-1 Urbani (AY278741), WIV1 (KF367457), SHC014 (KC881005), SARS-CoV-2 (MN985325.1), hACE2 (BAB40370), mACE2 (NP 081562). Protein similarity scores were calculated using BLOSUM62 matrix. Contact residues previously identified by crystal structures 19,20,33. Structure modelling was performed using Modeller (Version 9.20) and visualized using PyMOL (Version 1.8.6.0).

All viruses used were derived from an infectious clone of SARS-CoV-2, which was designed using similar strategies for SARS-CoV and MERS-CoV. The Q498Y/P499T substitutions were generated by site directed mutagenesis using the following primers: Forward: 5'-ATA TGG TTT CTA CAC GAC TAA TGG TGT TGG TTA CCA ACC-3' (SEQ ID NO:41), Reverse: 5'-TAG TCG TGT AGA AAC CAT ATG ATT GTA AAG GAA AGT AAC AAT TAA AAC CTT C-3' (SEQ ID NO:42). Viruses were derived following systematic cDNA assembly of the infectious clone, followed by in vitro transcription and electroporation into Vero E6 cells. Virus stocks were passaged once on Vero E6 cells and titered via plaque assay. Briefly, virus was serial diluted and inoculated onto confluent monolayers of Vero E6 cells, followed by agarose overlay. Plaques were visualized on day 2 post infection via staining with neutral red dye. Vero E6 cells were maintained in Dulbecco's modified Eagle's medium (DMEM; Gibco), 5% Fetal Clone II serum (FCII, Hyclone), and 1× antibiotic/antimycotic (Gibco). DBT-9 were maintained in DMEM, 10% FCII, and 1× antibiotic/antimycotic. For single step growth curve, Vero E6 cells were infected at a multiplicity of infection (MOI) of 1 for 1 hour. Inoculum was removed and monolayer was washed twice with PBS, and replace with media. At designated timepoints, media was removed without replacement, and stored at −80° C. until titered by plaque assay.

For ACE2 receptor usage, non-permissive DBT-9 cells were transfected with pcDNA3.1 empty-vector, pcDNA3.1-hACE2, or pcDNA3.1-mACE2 using lipofectamine 2000 (Invitrogen). 24 hrs post transfection, cells were infected at an MOI of 1 for 1 hour. Inoculum was removed and monolayer was washed twice with PBS, and replace with media. At 24 hrs post infection, media was removed, and total cellular RNA was collected via TRIzol (Invitrogen) and extracted using Direct-Zol RNA MiniPrep kit (Zymo Research). Viral RNA was quantified via qRT-PCR using TaqMan Fast Virus 1-Step Master Mix (Thermo Fisher Scientific) on a QuantStudio 3 (Applied Biosystems). SARS-CoV-2 RNA was quantified using US Centers of Disease Control and Prevention diagnostic N1 assay: Forward: 5'-GAC CCC AAA ATC AGC GAA AT-3' (SEQ ID NO:43), probe: 5'-FAM-AC CCC GCA TTA CGT TTG GTG GAC C-BHQ1-3' (SEQ ID NO:44), reverse: 5'-TCT GGT TAC TGC CAG TTG AAT CTG-3' (SEQ ID NO:45). Host 18S rRNA was used as housekeeping control (Invitrogen, product number 4319413E). Viral RNA was analyzed using ΔΔCt and fold change over viral RNA in empty-vector transfected cells.

For in vivo infections, hACE2 overexpressing mice were bred and maintained at University of North Carolina at Chapel Hill. BALB/c mice were obtained from Envigo (strain 047). Mice were infected with $10^5$ plaque forming units (PFU) intranasally under ketamine/xylazine anesthesia. Body weight and pulmonary function by whole body plethysmography (Buxco respiratory solutions, DSI Inc.) were monitored daily where indicated. At indicated timepoints, a subset of mice were euthanized by isoflurane overdose and tissue samples were harvested for titer and histopathology analysis. A subset of mice for nasal turbinate histopathology were perfused with 10% phosphate buffered formalin prior to tissue collection. Titer samples were stored at −80° C. until homogenized and titered by plaque assay as described above. Histopathology samples were fixed in 10% phosphate buffered formalin for 7 days before paraffin embedding and sectioning. Slide sections were stained with hematoxylin and eosin (H&E) or used for immunohistochemistry for SARS-CoV-2 nucleocapsid.

Non-select BSL2 Venezuelan equine encephalitis virus strain 3526 based replicon particles (VRPs) were generated to express GFP, SARS-CoV-2 spike (S), or nucleocapsid (N). Mice were vaccinated via hind footpad infection in 10 uL, boosted identically at 3 weeks post prime, and bled via submandibular bleed at 3 weeks to confirm presence of neutralizing antibodies. Neutralizing antibody levels were assessed via neutralization assay using SARS-CoV-2 WT expressing nanoluciferase (nLUC) in place of ORF7a. Briefly, the ORF7a gene of SARS-CoV-2 was removed from the molecular clone and nLUC inserted downstream of the ORF7a transcription regulatory sequence. Recombinant viruses encoding nLUC (SARS-CoV-2 nLUC) were recovered, titered and serial dilutions of sera were incubated with virus for 1 hour at 37° C., then added to monolayers of Vero E6 cells. 48 hrs post infection, viral infection was quantified using nLUC activity via Nano-Glo Luciferase Assay System (Promega). 50% inhibitory concentration ($IC_{50}$) values were calculated from full dilution curves.

Mice were challenged 4 weeks post boost with $10^5$ plaque forming units (PFU) intranasally under ketamine/xylazine anesthesia. Body weight was monitored daily. On day 2 post infection, mice were euthanized by isoflurane overdose and tissue samples were harvested for titer analysis.

Peg-interferon Lambda-1a was obtained from Eiger Bio-Pharmaceuticals by MTA in GMP prefilled syringes, 0.18 mg/syringe (0.4 mg/mL). Primary HAE cell cultures were obtained from the Tissue Procurement and Cell Culture Core Laboratory in the Marsico Lung Institute/Cystic Fibrosis Research Center at UNC. Human tracheobronchial epithelial cells were obtained from airway specimens resected from patients undergoing surgery. Primary cells were expanded to generate passage 1 cells and passage 2 cells were plated at a density of 250,000 cells per well on Transwell-COL (12 mm diameter) supports (Corning). Human airway epithelium cultures (HAE) were generated by differentiation at an air-liquid interface for 6 to 8 weeks to form well-differentiated, polarized cultures that resembled in vivo pseudostratified mucociliary epithelium. HAEs were treated with a range of peg-IFN-λ1 doses basolaterally for 24 hrs prior to infection. 1 μM remdesivir was used as a positive control. Cultures were infected at an MOI of 0.5 for 2 hours. Inoculum was removed and culture was washed three times with PBS. At 48 hrs post infection, apical washes were taken to measure viral replication via plaque assays as described above. This study was repeated in two separate human donors.

Mice were subcutaneously treated with a single 2 μg dose of peg-IFN-λ1 prophylactically at 18 hrs prior to infection, therapeutically at 12 hrs post infection, or PBS vehicle treated, and infected with $10^5$ plaque forming units (PFU) of SARS-CoV-2 MA intranasally under ketamine/xylazine anesthesia. Body weight was monitored daily. On day 2 post infection, mice were euthanized by isoflurane overdose and tissue samples were harvested for titer analysis.

Example 2: A Mouse-Adapted SARS-CoV-2 Induces Acute Lung Injury (ALI) and Mortality in Standard Laboratory Mice In this study, a lethal mouse model of mouse-adapted SARS-CoV-2 (referred to herein as SARS-CoV-2 MA10) pathogenesis was developed that recapitulates the age-related disease severity observed in humans, ALI/ARDS, and death in wild-type BALB/c mice. Like human infections, SARS-CoV-2 MA10 infection targets the conducting and distal airways, including airway epithelial cells and AT2 cells in the terminal bronchi and alveoli, and replicates in nasal olfactory epithelium sustentacular cells and Bowman's glands. The SARS-CoV-2 MA10 infection in BALB/c mice induces lung disease characterized by damaged airway epithelium, exfoliated cells in small airways, fibrin deposition, occasional hyaline membrane formation, pulmonary edema, surfactant expression loss and congestion which can progress to ARDS, especially in aged animals. Many Th1 proinflammatory cytokines were elevated after infection, including IL-6. SARS-CoV-2 MA10 infection of C57BL/6J mice caused a milder phenotype, whereas infection of immunodeficient type I and II interferon receptor double knockout C57BL/6J mice resulted in severe weight loss and morbidity. Notably, mice vaccinated with viral vector-delivered SARS-CoV-2 spike protein were protected from clinical disease and infection of the lung. The development of SARS-CoV-2 MA10 provides a much-needed standard laboratory mouse model that recapitulates the age-related severity spectrum and acute lung injury phenotype observed in human SARS-CoV-2 infections. It also provides a robust model to mechanistically address novel questions in COVID-19 immunity.

Figures 5A, 5B:
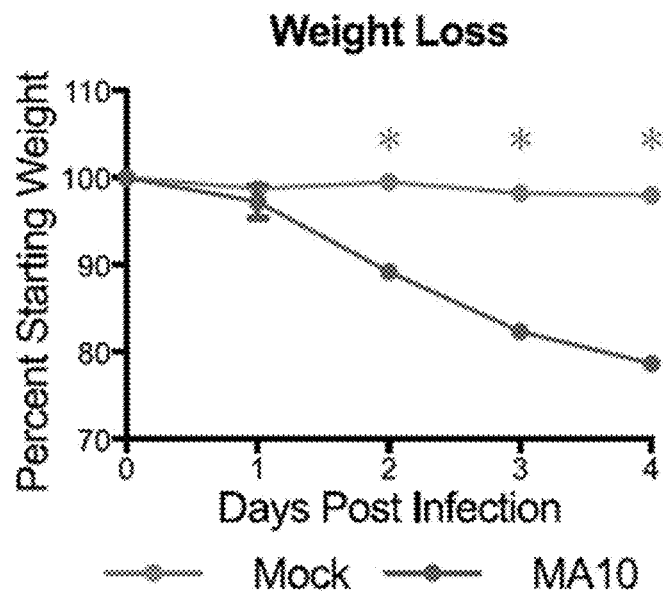
FIG. 5A shows a plot of 10-week-old BALB/c mice that were mock infected with PBS or infected with $10^5$ PFU of plaque purified virus from passage 10, SARS-CoV-2 MA10, and monitored for weight loss. Data analyzed by mixed effects analysis followed by Sidak's multiple comparisons.
FIG. 5B shows a table of mouse adaptations present in plaque purified SARS-CoV-2 MA10 relative to parental SARS-CoV-2 MA. 'WT': wild-type; 'nsp': nonstructural protein; 'ORF': open reading frame.
Figure 5C:
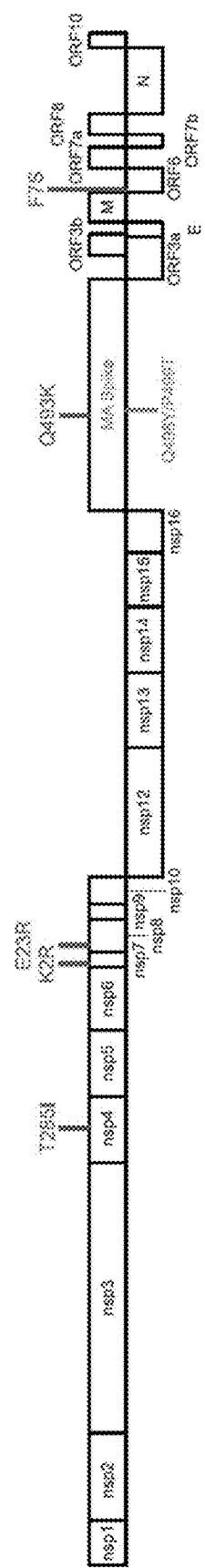
FIG. 5C shows a schematic of SARS-CoV-2 genome with locations of mouse adaptations from FIG. 5B shown.
Figure 5D:
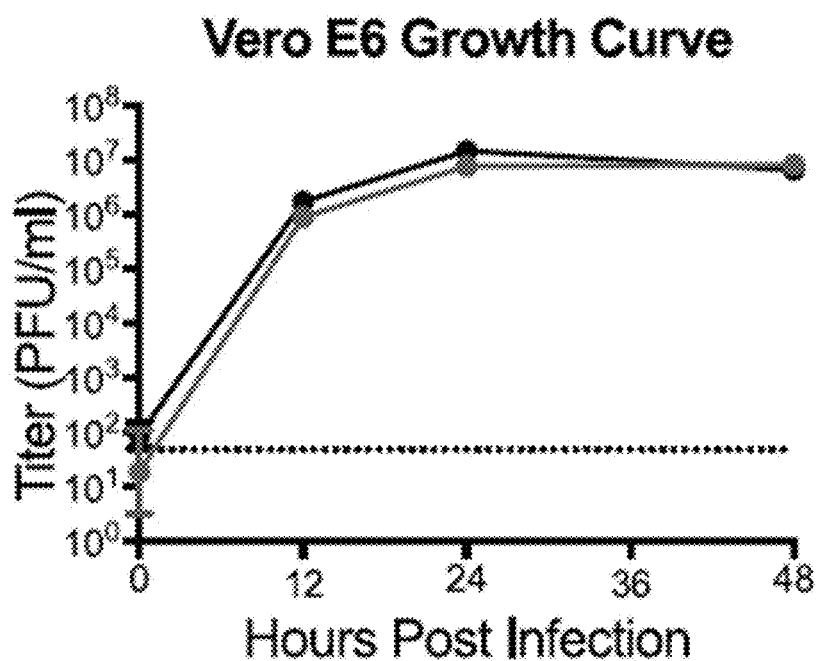
FIGS. 5D and 5E show single step growth curve of SARS-CoV-2 WT and SARS-CoV-2 MA10 in Vero E6 cells (FIG. 5D) or differentiated primary human bronchiolar airway epithelial cells (HBE)
Figure 5E:
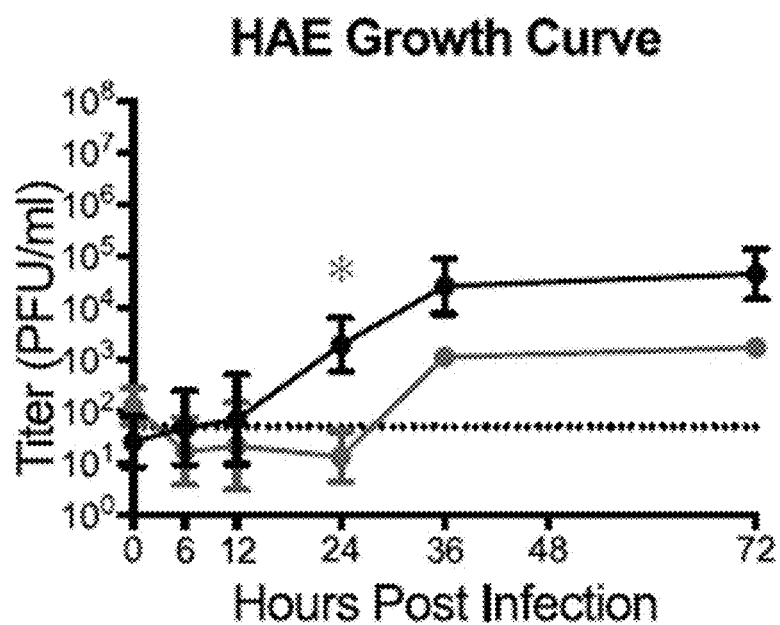

Adaptation of SARS-CoV-2 MA via serial passaging in vivo. A recombinant mouse adapted strain of SARS-CoV-2 (SARS-CoV-2 MA) capable of utilizing mACE2 for viral entry was developed by remodeling the spike and receptor binding interface via reverse genetics. While SARS-CoV-2 MA mediated infection of wild-type mice, young adult mice did not display the major clinical manifestations or hallmarks of ALI. To improve the model, we used experimental evolution in vivo via serial passage of SARS-CoV-2 MA in the lungs of young adult BALB/cAnNHsd mice (herein referred to as "BALB/c" mice) every two days to select for more virulent strains. With passage, we observed a linear decrease in body weight over time achieving greater than 10% body weight loss on 2 dpi by passage ten (P10) (FIG. 5A). We confirmed the virulence of the virus population generated at P10 using a plaque purified clonal isolate (SARS-CoV-2 MA10) from this passage in young adult BALB/c mice. Deep sequencing of mouse lung total RNA from the 10 passages, plaque purified SARS-CoV-2 MA10, and four additional plaque purified passage 10 viruses, was performed on the to identify the changes responsible for the increased pathogenicity and rare variants. In addition to the spike Q498Y/P499T substitutions engineered into the parental SARS-CoV-2 MA, SARS-CoV-2 MA10 included 5 additional nucleotide changes, all resulting in nonsynonymous coding changes (FIGS. 5B-5C and Table 1). These mutations emerged in an ordered fashion and included changes in nonstructural protein 4 (nsp4) (C9438T), nsp7 (A11847G), nsp8 (A12159G), spike (S; C23039A), and open reading frame 6 (ORF6; T27221C). Some sequence heterogeneity was observed across the plaque purified viruses, though SARS-CoV-2 MA10 had the fewest mutations and most represented the viral population found at passage 10. The SARS CoV-2 MA10 maintained the ability to utilize non-human primate ACE2 and replicated and formed plaques in Vero E6 cells (FIG. 5D), consistent with utility for viral propagation and titration. Importantly, SARS-CoV-2 MA10 was also attenuated compared to wild-type SARS-CoV-2 (SARS-CoV-2 WT) in primary human bronchiolar epithelial cells (HBEs) (FIG. 5E), suggesting decreased fitness in human cells.

SARS-CoV-2 MA10 causes acute lung injury in young BALB/c mice. To gain insight into the dose-dependent pathogenic potential of SARS-CoV-2 MA10, we performed dose ranging studies in 10-week-old BALB/c mice infected with either PBS (mock), $10^5$ PFU of the parental SARS-CoV-2 MA, or $10^2$, $10^3$, $10^4$ and $10^5$ PFU SARS-CoV-2 MA10. We observed a dose-dependent increase in morbidity and mortality over the course of 14 days with SARS-CoV-2 MA10. Mortality rates of 20% and 60% were recorded for infection with $10^4$ and $10^5$ PFU, respectively. Notably, infection with $10^2$ PFU of SARS-CoV-2 MA10 produced an increased weight loss as compared to $10^5$ PFU infection with the parental SARS-CoV-2 MA strain, highlighting the increased pathogenicity gained through passaging. To best capture severe disease phenotypes without excessive mortality, we proceeded with $10^4$ PFU of SARS-CoV-2 MA10 as the standard infection dose for young adult BALB/c mice.

Figure 6A:
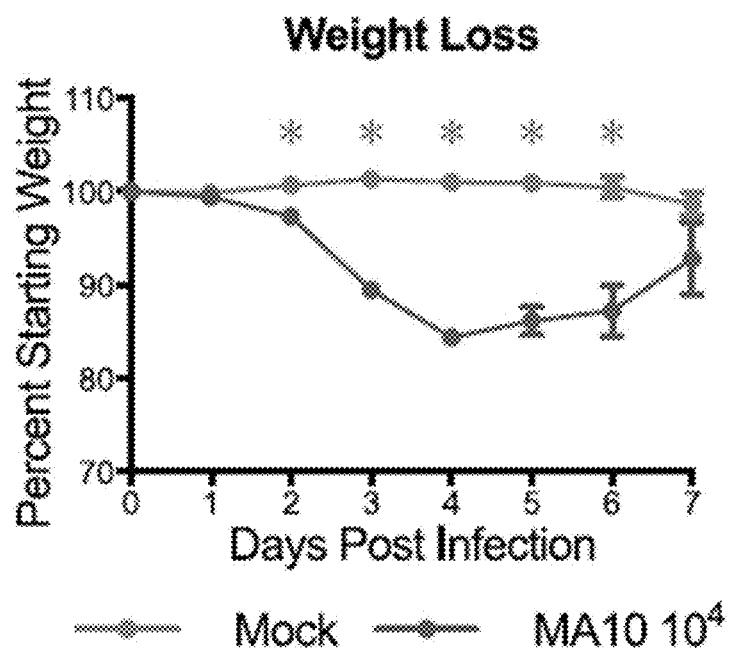
FIGS. 6A-6H show plots of 10-week-old female BALB/c mice mock infected (n=47) or infected with $10^4$ PFU SARS-CoV-2 MA10 (n=59).
Figure 6B:
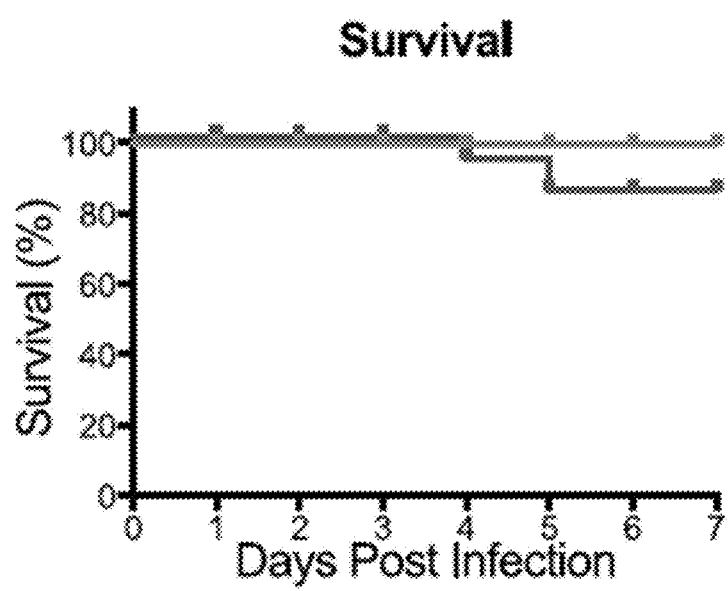
Figure 6C:
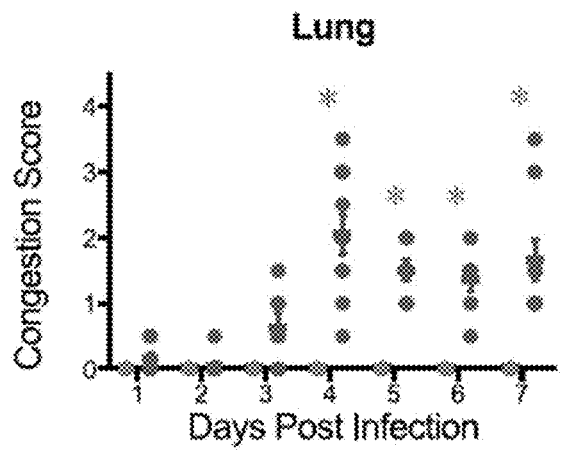
Figure 6D:
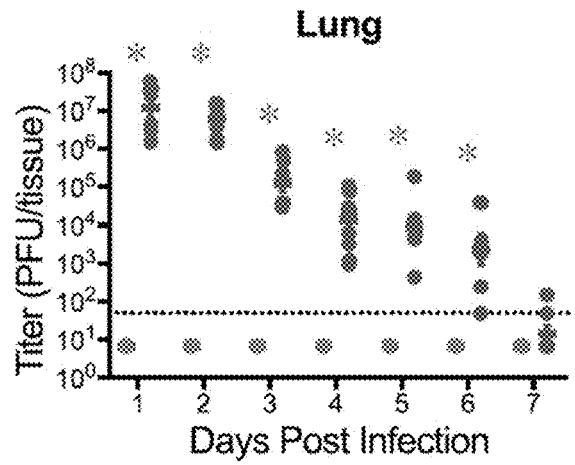
Figure 6E:
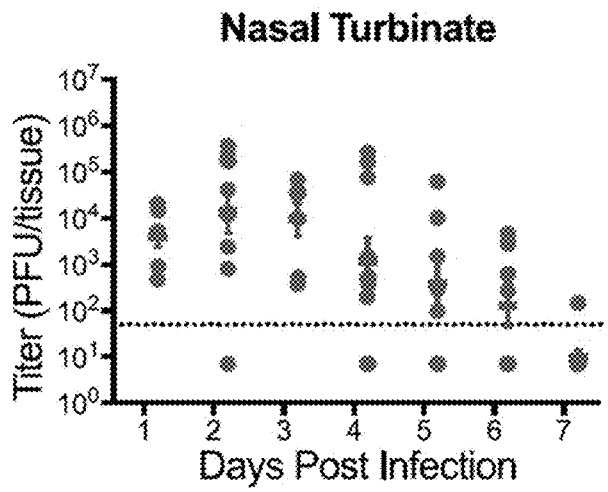

To characterize the pathogenesis of SARS-CoV-2 MA10 in young BALB/c mice, we examined the kinetics of disease in mice through 7 days post infection using an intranasal inoculating dose of $10^4$ PFU. SARS-CoV-2 MA10 infected mice rapidly lost weight and reached maximum weight loss at day 4 (losing 16%% of starting weight) (FIG. 6A). At 5 days post infection (dpi), the weight loss trajectories of infected mice diverged, with many mice recovering body weight juxtaposed to mice that continued to lose weight, collectively resulting in a ~15% mortality rate (FIG. 6B). At the time of necropsy, acute stage lung damage was noted grossly as firm, red, heavy lobes that were scored based on the extent of congestion-related discoloration (indicative of edema and diffuse alveolar damage) that peaked at 4 dpi and remained high through 7 dpi (FIG. 6C). Virus replication in the lung peaked 1-2 dpi and was absent in most surviving mice by 7 dpi (FIG. 6D). Viral replication in the upper respiratory tract (measured by viral titer in the nasal cavity) remained high on 1-3 dpi but was non-detectable in most mice by 5 dpi (FIG. 6E).

Figure 6F:
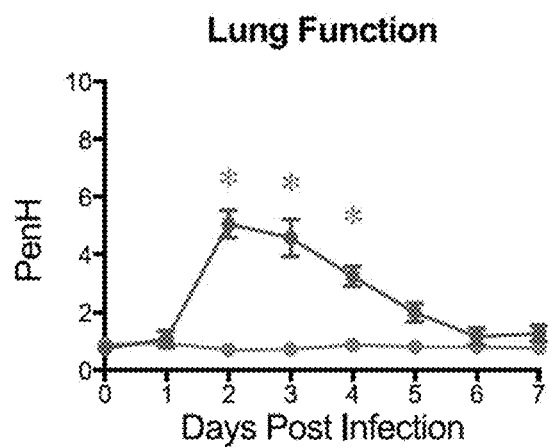
Figure 6G:
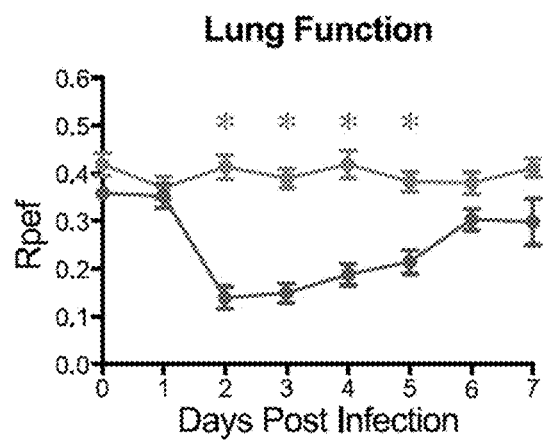
Figure 6H:
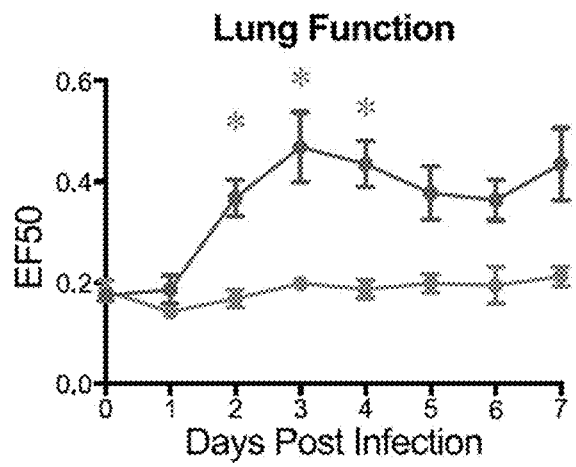
Figure 7A:
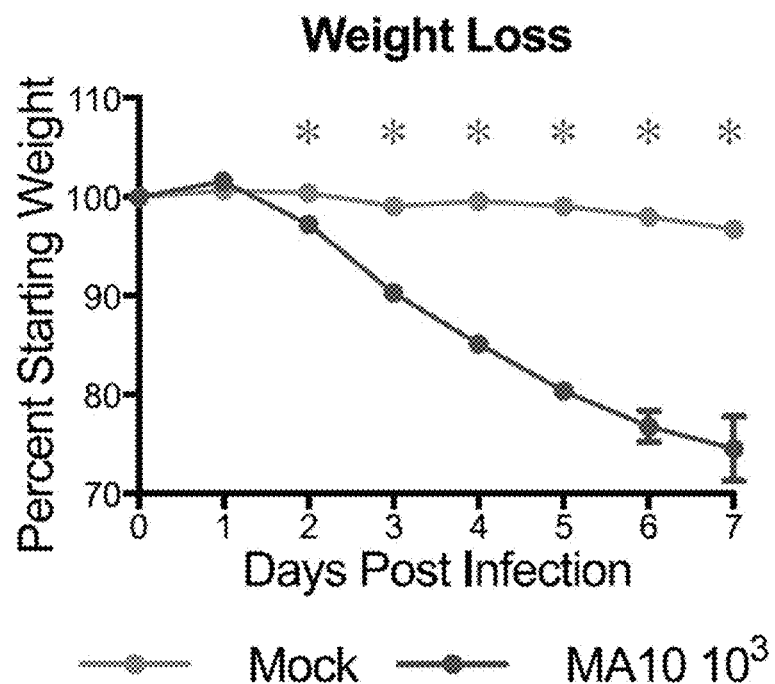
FIGS. 7A-7D show data plots from SARS-CoV-2 MA10 infection in old mice, wherein 1-year old female BALB/c mice were mock infected (n=51) or infected with $10^4$ PFU SARS-CoV-2 MA10 (n=65).
Figure 7B:
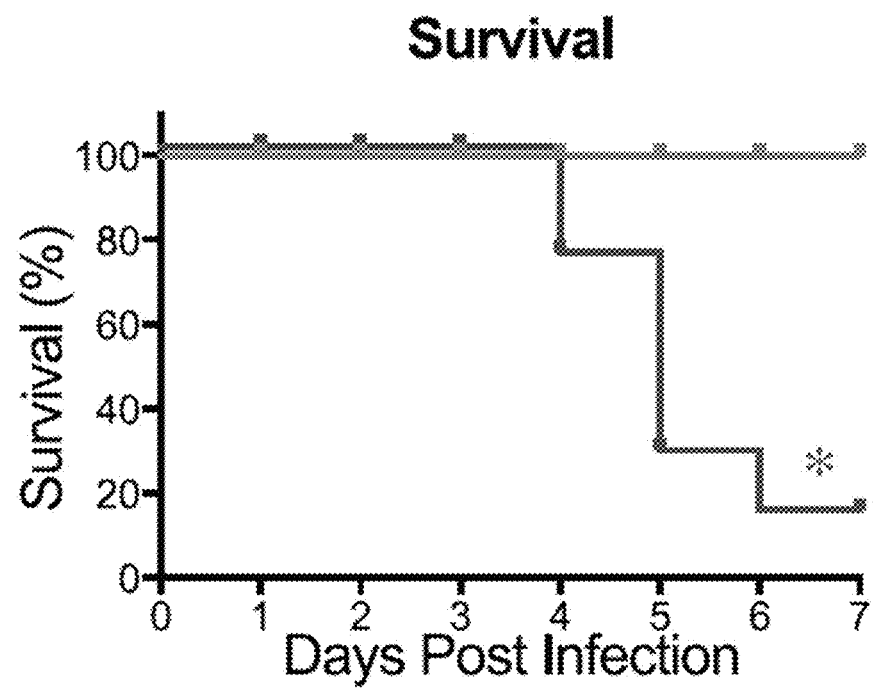
Figure 7C:
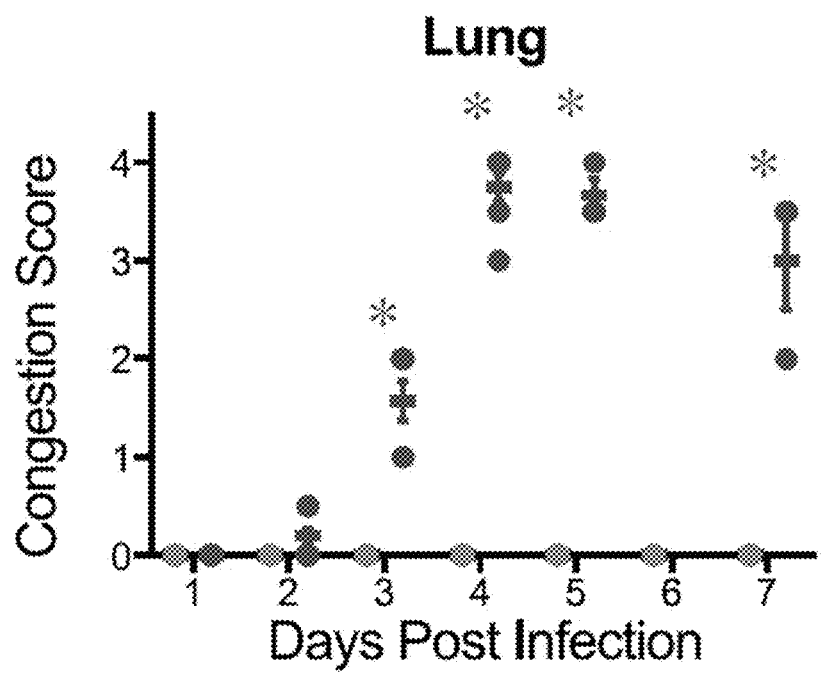
Figure 7D:
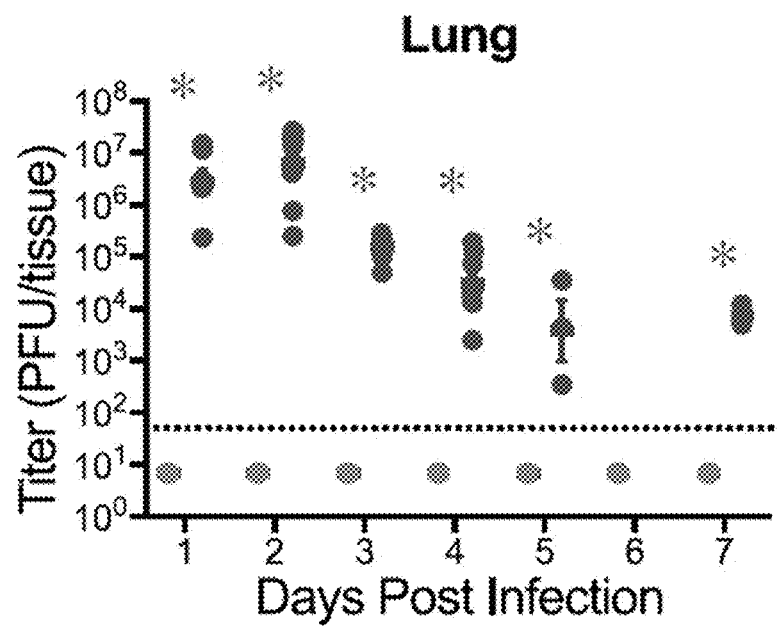

To gain insight into the impact of infection on lung physiology, pulmonary function was measured over time via whole body plethysmography (WBP). As compared to control mice, infected mice exhibited a loss in pulmonary function as indicated by significant changes in PenH and Rpef, measures of airway obstruction, and $EF_{50}$, a measurement of exhalation flow rate (FIGS. 6F-6H).

Figure 8A:
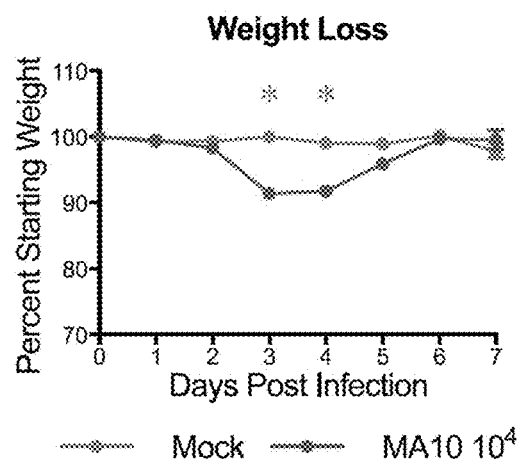
FIGS. 8A-8C show data plots from 10-week-old female BALB/c mice that were mock infected (n=46) or infected with $10^4$ PFU SARS-CoV-2 MA10 (n=57).
Figure 8B:
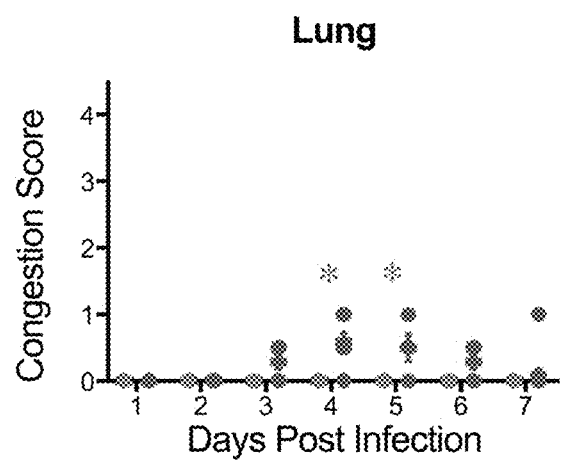
Figure 8C:
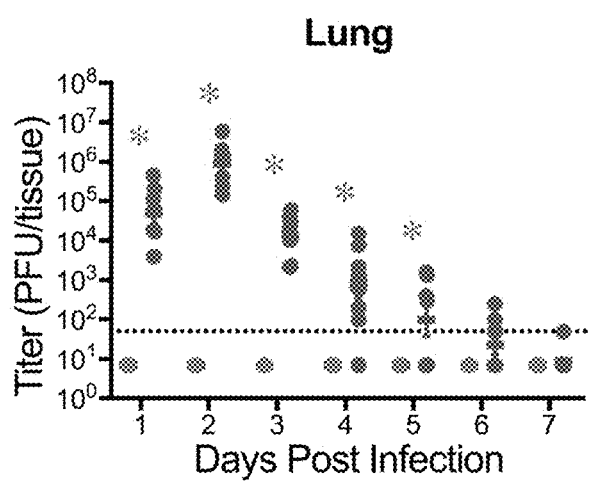

Histopathologic analyses at 2, 4, 7 dpi revealed early multifocal damage to conducting airway epithelia (including bronchioles) that corresponded to viral antigen staining, which was intense on 2 dpi, waned by 4 dpi, and was absent by 7 dpi. Often, bronchial damage progressed to segmental epithelial denudation with an accumulation of inflammatory cells, sloughed epithelial cells, cellular debris, fibrin deposition and plasma proteins in the airway lumens. Later post-SARS-CoV-2 MA10 infection, airway epithelia became hyperplastic with regeneration. The distal alveolar ducts and sacs were markedly altered by infection, displaying hallmarks of diffuse alveolar damage (DAD) and multifocal positive labeling of pneumocytes for viral antigen at early time points after infection. Histologic changes included hypercellular thickening of the alveolar septae caused by infiltrating immune cells, pneumocyte degeneration and necrosis, congestion of small vessels and capillaries, endothelial activation, increased neutrophils with extravasation, exudation of proteinaceous fluid and fibrin with occasional organization into hyaline membranes, and increased numbers of alveolar macrophages. While later time points featured increased numbers of lymphocytes organizing around bronchioles, lymphocytic cuffing was not a prominent pathologic feature in comparison to findings induced by other respiratory viral pathogens. Importantly, the most severe, lingering damage over the time course was in the alveolar region.

The pathology of SARS-CoV-2 MA10-infected lungs was blindly quantified utilizing two metrics of ALI. First, diffuse alveolar damage (DAD) was assessed based on the degree of cellular sloughing and necrosis. SARS-CoV-2 MA10 induced DAD as early as 2 dpi and was maintained through 7 dpi). Second, the American Thoracic Society (ATS) has generated a small animal model ALI scoring scheme that assesses neutrophil presence in the interstitium and alveolar space, hyaline membrane formation, protein accumulation, and alveolar septal thickening. Consistent with DAD scores, ATS ALI scores were increased in SARS-CoV-2 MA10 infected mice at 2 dpi and increased through 7 dpi. Immunohistochemistry (IHC) staining for viral nucleocapsid revealed intense staining at 2 dpi and lack of staining by 7 dpi, consistent with the lung viral titer data. At 2 dpi, viral antigen was detected in conducting airway epithelia and in the alveoli, consistent with alveolar type II pneumocyte distribution patterns.

Increased morbidity and mortality in old mice after SARS-CoV-2 MA10 infection. Because SARS-CoV-2 and other emerging human coronaviruses exhibit an age-dependent increase in disease severity, we investigated whether SARS-CoV-2 MA10 infection of aged mice resulted in an increased disease severity. In comparison to young mice, 1-year-old mice were highly susceptible to SARS-CoV-2 MA10, with high morbidity and nearly 100% mortality when infected with $10^4$ and $10^5$ PFU. While mice infected with $10^3$ PFU rapidly lost weight with very few animals surviving, those infected with $10^2$ PFU did not exhibit disease signs and all survived, suggesting a threshold of virus $>10^2$ was necessary to cause significant disease in 1-year-old mice. Accordingly, we selected the lowest dose that caused severe disease ($10^3$ PFU) as the standard infection dose for 1-year-old mice. With this dose, the kinetics of weight loss were similar to young BALB/c mice. However, unlike infected young adult mice, all aged mice continued to lose weight over time and ultimately lost 30% of their starting weight, succumbing to infection and/or reaching the criteria for humane euthanasia (FIG. 7A). Overall, we observed increased mortality starting on day 4 after infection with only ~15% survival by day 7 (FIG. 7B). Thus, data presented at late time points such as 6 or 7 dpi are biased towards rare survivors.

Gross pathological evaluations at necropsy revealed macroscopically detectable discoloration of lung tissue that achieved maximal severity on days 4 and 5 after infection (FIG. 7C). Virus replication in aged mice peaked 1 to 2 dpi ($5.3\times10^6$ PFU/tissue and $1.2\times10^7$ PFU/tissue, respectively), values similar to young adult mice. In contrast with young adult mice, in which virus was cleared by 7 dpi, significant levels of infectious virus remained in the lungs of aged mice at later time points (FIG. 7D). Low levels of infectious virus were present in the serum at 2 dpi. Minimal virus was found in the heart, which may reflect residual virus from the serum, and virus was not detected in brain at the time of peak lung titer (2 dpi). Viral protein was not detected in the heart, liver, small intestine, kidney, or spleen. Old mice also exhibited viral titers in the nasal cavity over the first 3 days of infection (peak on 3 dpi at $2\times10^4$ PFU/tissue), consistent with young adult mice. Infection with SARS-CoV-2 MA10 also disturbed lung function in aged mice in a similar, but more prolonged, manner compared to young mice with significant changes in PenH, Rpef, and EF50 at 2-5 dpi.

Histological analyses revealed severe DAD and higher ATS ALI scores at later time points throughout the lung in 1-year-old mice, consistent with the more pronounced interstitial congestion, epithelial damage, immune cell infiltration, and edema in the older animals. Viral antigen was detected in small airways and alveolar regions at 2 and 4 dpi. Viral RNA was also detected in the olfactory epithelium at 2 dpi, concordant with nasal cavity viral titers. At 4 dpi, the olfactory epithelium was severely damaged, likely contributing to reduced nasal cavity viral titers, and infection had spread to the Bowman's gland in the submucosa.

Many viral diseases are associated with a systemic cytokine storm. We analyzed the chemokine and cytokine responses in the serum and lungs of 1-year-old BALB/c mice at 2 and 4 dpi. At 2 dpi, several proinflammatory cytokines were elevated in the lungs of SARS-CoV-2 infected mice, while few were elevated systemically in the serum. For instance, IL-6, IL-1α, IL-1β, TNF-α, MCP-1, and IFN-γ were highly elevated in the serum and/or lungs of infected mice, similar to reports in humans. It remains uncertain as to whether these elevated cytokines contribute to severe disease outcomes afterinfection.

Ameliorated disease and no mortality in C57BL/6J mice after SARS-CoV-2 MA10 infection. C57BL/6 is the most commonly used mouse strain and is the genetic background for the majority of genetically engineered mice. Because host genetic background dependent differences in disease susceptibility have been described for many infectious diseases including SARS-CoV, we evaluated SARS-CoV-2 MA10 infection in young adult C57BL/6J mice. In comparison to BALB/c mice, 10-week-old C57BL/6J mice exhibited less severe disease and only the two highest doses ($10^4$ and $10^5$ PFU) were associated with significant weight loss, but no mortality after infection. Therefore, we performed a detailed analysis of the $10^4$ PFU infectious dose over 7 days for a direct comparison between young BALB/c and C57BL/6J mice. After infection with $10^4$ PFU, C57BL/6J mice exhibited a transient 10-15% weight loss (peaked on 3 dpi and 4 dpi) (FIG. 8A) without mortality. Gross congestion scores in lungs at the time of harvest never rose above a score of 1 (roughly 25% lung involvement) and declined from 3 dpi until 7 dpi (FIG. 8B). A clear peak in viral replication in the lungs was observed on 2 dpi ($1.6 \times 10^6$ PFU/tissue) which was about one order of magnitude lower than peak titers observed in BALB/c mice. After 2 dpi, titers decreased steadily and were not detectable by 7 dpi (FIG. 8C). In addition, viral loads in the nasal cavity were relatively low through 3 dpi ($2 \times 10^3$ to $1.2 \times 10^4$ PFU/tissue) and were undetectable by 4 dpi. Changes in lung function as measured by WBP were similar in pattern for the two mouse strains, but C57BL/6J mice exhibited restored lung function to near baseline levels by 5 dpi, whereas abnormalities in BALB/c mice persisted until 7 dpi. Similarly, the patterns of histologic changes were equivalent in C57BL/6J mice to young BALB/c mice, but the magnitudes of the acute lung injury scores were dramatically attenuated in C57BL/6J mice.

SARS-CoV-2 MA10 cellular tropism. To characterize the tissue and cellular tropism of SARS-CoV-2 MA10, BALB/c mouse nasal and lung tissues were probed for the SARS-CoV-2 viral nucleocapsid and tissue/cell type markers by RNA in situ hybridization (ISH) and immunohistochemistry. In the proximal conducting airways (e.g. trachea, bronchi), little, if any, SARS-CoV-2 MA10 infection was identified. However, robust viral infection was identified in terminal bronchioles which connect to the alveolar spaces. In the SARS-CoV-2 MA10-infected mouse terminal bronchiolar epithelial region, expression of Scgb1a1, which is a secretory club cell marker, largely disappeared whereas Foxj1, a ciliated cell marker, persisted. IHC identified SARS-CoV-2 MA10 nucleocapsid expression in non-ciliated cells with occasional colocalization with CCSP, suggesting that secretory club cells were infected by SARS-CoV-2 MA10 and subsequently lost Scgb1a1 expression. This cellular tropism of SARS-CoV-2 MA10 is different in human airways, perhaps reflecting different cell levels for ACE2 expression between human vs mice, i.e., ciliated vs secretory club, respectively.

In alveoli, ISH studies of mock infected mice identified the two major epithelial cell types, i.e., AT1 (Ager expressing) and AT2 (Sftpc, Sftpb expressing) cells. In SARS-CoV-2 MA10-infected mice, Sftpc and Sftpb expression characteristic of AT2 cells virtually disappeared, whereas Ager expression associated with AT1 cells persisted at 2 dpi. IHC identified occasional cells expressing a third AT2 cell marker (LAMP3) that also co-expressed the SARS-CoV-2 MA10 nucleocapsid. Collectively, the loss of surfactant protein transcripts, but not AGER, staining and colocalization of a third AT2 marker (LAMP3) with virus, argues for selective infection by SARS-CoV-2 MA10 of AT2 in the alveolus. The finding that SARS-CoV-2 MA10-infected AT2 cells suppressed expression of selective cell type-specific genes, e.g., Sftpc and Sftpb, is consistent with findings in infected human AT2 cells in vitro.

The nasal cavity of the mouse is comprised of ~50% respiratory epithelium and 50% olfactory epithelium. As noted above, SARS-CoV-2 MA10 RNA was detected in olfactory epithelium, as defined anatomically and by the olfactory sensory neuron marker (OSN) marker, Uchl1. Notably, viral RNA was not detected in cells expressing Uchl1, indicating that SARS-CoV-2 MA10 likely infected sustentacular cells rather than OSNs. The selective olfactory infection by SARS-CoV-2 MA10 is likely associated with altered olfactory function commonly observed in subjects with COVID-19.

Figure 9:
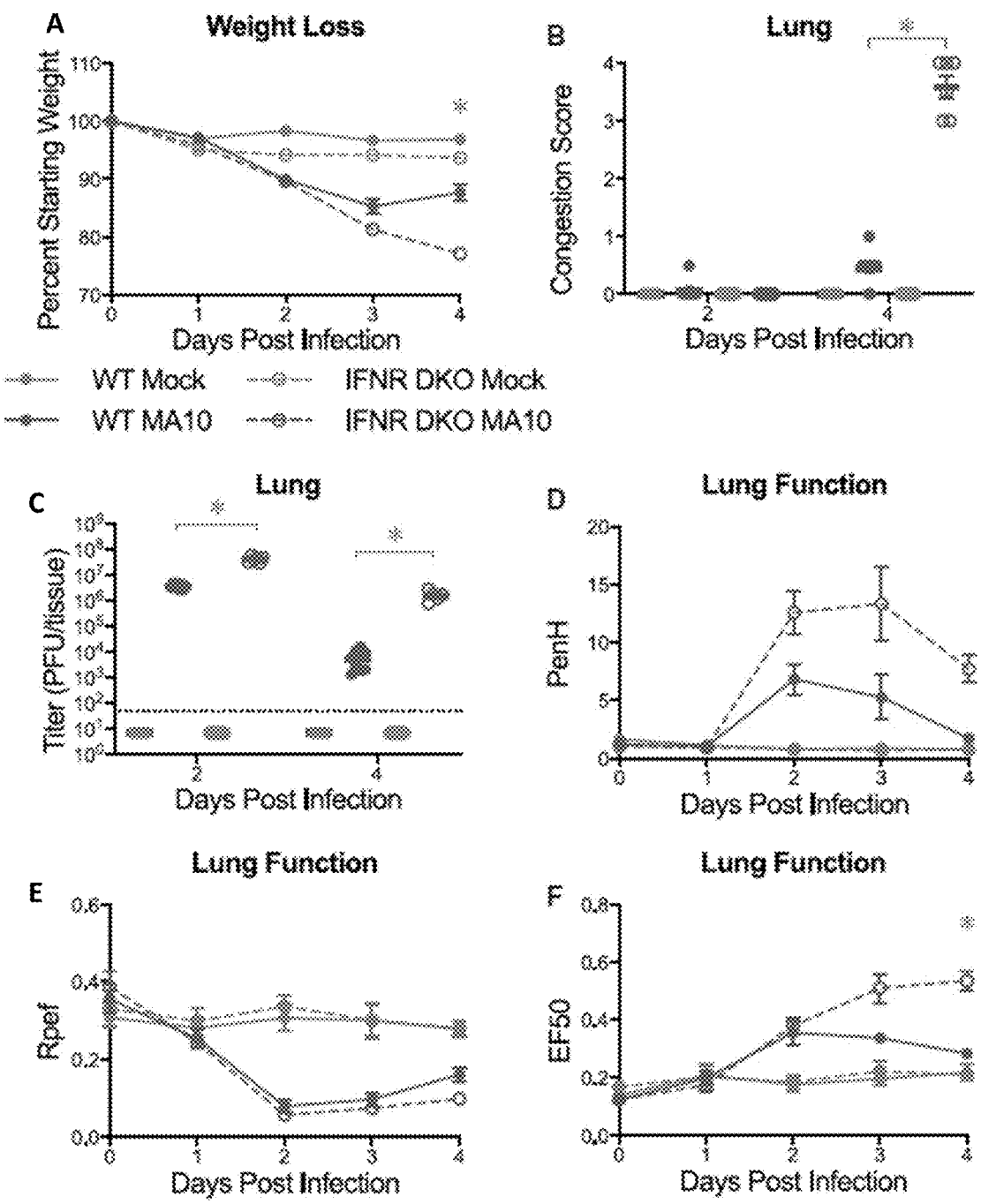
FIG. 9 shows data plots from 10-week-old male and female type I and II interferon receptor double knock-out (IFNR DKO; n=12 mock, n=19 MA10) and wild-type (WT; n=11 mock, n=13 MA10) control mice mock infected or infected with $10^4$ PFU SARS-CoV-2 MA10.

Interferon signaling is protective in SARS-CoV-2 MA10 infection. We next tested whether the pathogenic SARS-CoV-2 MA10 virus could be used with genetically deficient mice to elucidate aspects of underlying molecular pathways and networks that regulate SARS-CoV-2 disease. Interferon signaling plays an important role in controlling and regulating disease severity after infection with many viruses, including coronaviruses. SARS-CoV-2 has also been reported to be sensitive to type I and III interferons in human cells in vitro and mice in vivo. Consequently, we infected C57BL/6J mice lacking the type I and II interferon receptors (IFNR DKO) and wild-type controls with $10^4$ PFU of SARS-CoV-2 MA10. IFNR DKO mice were more susceptible to SARS-CoV-2 MA10 as indicated by the prolonged weight loss compared to wild-type mice (FIG. 9 panel A). Animals were harvested on planned harvest days. At 4 dpi, SARS-CoV-2 MA10 IFNR DKO mice displayed much higher congestion scores (FIG. 9 panel B), which were associated with higher viral titers on 2 and 4 dpi in IFNR DKO mice (FIG. 9 panel C). These data suggest that IFNs are important in limiting viral replication and assisting in virus clearance in vivo. Consistent with these data, lung function abnormalities were more pronounced and prolonged in infected IFNR DKO mice (FIG. 9 panels D-E).

Figure 10:
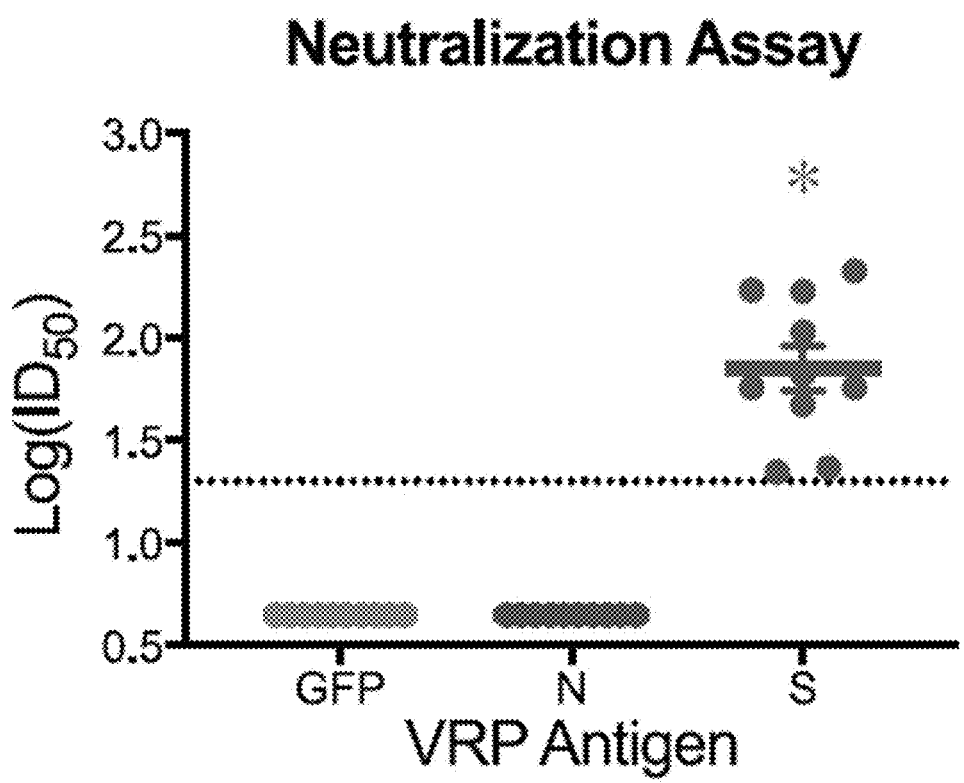
FIG. 10 shows a plot of neutralization assays from 1-year-old female BALB/c mice that were vaccinated with $10^3$ virus replicon particles (VRPs) expressing SARS-CoV-2 wild-type spike (S, n=10), nucleocapsid (N, n=10), or GFP (n=10). Mice received a boost 3 weeks after prime immunization and submandibular blood samples were taken to be analyzed via neutralization assays. All mice were challenged 4 weeks after the boost immunization. Neutralization of SARS-CoV-2 WT by sera from vaccinated mice 3 weeks post boost. $ID_{50}$: inhibitory concentration necessary to achieve 50% virus neutralization. Dotted line represents limit of detection. Undetected samples are plotted at half the limit of detection. Log transformed data analyzed via 1-factor ANOVA followed by Holm-Sidak's multiple comparisons. Asterisks represent p<0.05.

SARS-CoV-2 MA10 allows rapid evaluation of medical counter measurements. As previously shown for SARS-CoV-2 MA, mouse adapted viral strains allow for rapid testing of prevention and intervention strategies. The SARS-CoV-2 MA10 murine model adds to measurements of viral load the ability to evaluate changes in clinical parameters (weight loss, lung function, and pathologic changes) and mortality. Utilizing our previously described non-select BSL2 Venezuelan equine encephalitis viral replicon particle (VRP) system, 10-week-old young adult and 1-year-old ("aged") BALB/c mice were immunized with $10^3$ VRPs expressing SARS-CoV-2 WT spike (S), nucleocapsid (N), and GFP control, followed by a boost at 3 weeks, and challenged with SARS-CoV-2 MA10 4 weeks post boost (7 weeks post prime). Neutralization assays using nLuc expressing reporter virus revealed strongly neutralizing activity in the serum from mice at 3 weeks post boost from spike, but not serum from nucleocapsid or GFP vaccinated mice (FIG. 10). Of note, older (1-year-old) animals exhibited significantly reduced neutralization titers as compared to 10-week-old animals, capturing age related vaccine vulnerabilities often observed in human populations. Notably, polyclonal sera had similar neutralization titers for both SARS-CoV-2 and SARS-CoV-2 MA containing two of three receptor binding domain changes present in MA10, suggesting that the SARS-CoV-2 MA10 model can accurately be used to test vaccine efficacy. Only mice vaccinated with SARS-CoV-2 spike expressing VRPs exhibited disease protection as demonstrated by an absence of reductions in in body weight, protection from death, and total elimination of viral titers in the lower respiratory tract (lungs). Only one old mouse had detectable lung titer, corresponding to the mouse with the lowest serum neutralization titer. Interestingly, viral titers were still detectable on 2 and 4 dpi after infection in the nasal cavity of immunized young and old mice, suggesting that mucosal immunity in the nasal cavity may be difficult to achieve by systemic immunization. Importantly, significant improvements in lung function were measured in both age groups in VRP-S vaccinated mice vs VRP-GFP or VRP-N controls.

The virus strains icSARS-CoV-2 WT, icSARS-CoV-2 MA, and icSARS-CoV-2-nLuc stocks were generated in our laboratory. SARS-CoV-2 MA10 was generated in this study via serial lung passaging in mice for 10 passages. Briefly, mice were infected with the SARS-CoV-2 MA stock virus for the first passage and with lung homogenates of the previous passage for all following passages (passage 2-10). Clonal isolate from P10 was plaque purified to obtain SARS-CoV-2 MA10. All virus stocks were propagated on Vero E6 cells in minimal essential medium containing 10% fetal bovine serum (HyClone) and supplemented with penicillin/kanamycin (Gibco). Virus plaques were visualized by neutral red staining for two to three days. All viral infections were conducted under biosafety level 3 (BSL-3) conditions at negative pressure and personnel was protected wearing Tyvek suits connected to personal powered-air purifying respirators. The parental SARS-CoV-2 MA virus was derived from an infectious clone of SARS-CoV-2 and further genetically engineered to introduce Q498Y/P499T substitutions into the spike protein. Passage 1 SARS-CoV-2 WT and MA stocks were grown using Vero E6 cells and titered via plaque assay. Briefly, serially diluted virus was added to a monolayer of Vero E6 cells and overlayed with media containing 0.8% agarose. After three days plaques were visualized via staining with Neutral Red dye and counted.

Vero E6 cells were cultured in Dulbecco's modified Eagle's medium (DMEM, Gibco), 5% Fetal Clone II serum (Hyclone), and 1× antibiotic/antimycotic (Gibco). For single step growth curves, cells were infected with a multiplicity of infection (MOI) of 0.5 for 1 hour. After removal of inoculum, cells were washed twice with PBS and 2 mL of media added. At designated timepoints supernatant was harvested and stored at −80° C. until further analysis. Well differentiated primary human bronchiolar airway epithelial (HBE) cells were cultured in ALI media. In order to generate a growth curve, cells were infected with a MOI of 0.5 for 2 hours after which the inoculum was removed, cells were rinsed three times with PBS and replaced with media. At designated timepoints, HAEs were apically washed with 2004 1×PBS for 10 minutes and samples stored at −80° C. until further analysis. Clonal isolate from P10 was plaque purified from a plaque assay of a P10-infected mouse lung homogenate via inoculation of Vero E6 cells with an agar stab, generating a passage 1 SARS-CoV-2 MA10 stock. A passage 2 stock was grown, and supernatant viral RNA was sequenced. A larger passage 3 stock was grown, titered, and used for all subsequent experiments.

Viral RNA from clarified cell culture supernatant was isolated using TRIzol LS (Invitrogen) using a Direct-zol RNA Kit (Zymo Research) following manufacturers suggested protocol and quantified by NanoDrop (ThermoFisher Scientific). dsDNA was synthesized by random priming with Random Primer 9 (New England BioLabs) on 500-1000 ng of each isolate's RNA and reverse transcribed using Super Script II (Sigma-Aldrich) to make cDNA followed by second strand synthesis using NEBNext Ultra II Non-Directional RNA Second Strand Synthesis Module (New England BioLabs) following the manufacturer's suggested protocols. dsDNA was quantified using Qubit dsDNA HS Assay Kit (ThermoFisher Scientific). Libraries were prepared using Nextera XT DNA Library Preparation Kits (Illumina) and sequenced on a NovaSeq 6000 System (Illumina) with paired end reads (2×151). SARS-CoV-2 MA10 passage 2 reads were de novo assembled using CLC Genomics Workbench v12 (Qiagen) to confirm initial viral sequence.

For in vivo experiments, BALB/cAnNHsd mice were obtained from Envigo (strain 047). C57BL/6J mice were obtained from the Jackson Laboratory (strain 000664). Type I and II interferon receptor double knock out (IFNR DKO) mice were originally obtained from the Whitmire laboratory and bred at the University of North Carolina at Chapel Hill. Anesthetized (ketamine/xylazine) mice were intranasally infected with $10^5$ PFU SARS-CoV-2 MA and different doses of SARS-CoV-2 MA10 diluted in PBS where indicated. Clinical signs of disease (weight loss and lung function) were monitored daily. Lung function was assessed utilizing whole body plethysmography (WBP; DSI Buxco respiratory solutions, DSI Inc.) by allowing mice to acclimate in WBP chambers for 30 minutes followed by 5 minutes of data recording as described previously. Acquired data was analyzed using FinePointe software. Mice were euthanized by isoflurane overdose at indicated time points when samples for titer (caudal right lung lobe) and histopathological analyses (left lung lobe) were collected. All animals in this manuscript that are recorded as "dead" were either found dead in cage or were moribund and euthanized as they approached 70% of their starting body weight which is the defined human endpoint according to the respective animal protocol. Importantly, mice were randomized and assigned to specific harvest days before the start of the experiment. Lung viral titers were determined by plaque assay. Briefly, right caudal lung lobes were homogenized in 1 mL PBS using glass beads and serial dilutions of the clarified lung homogenates were added to a monolayer of Vero E6 cells. After three days plaques were visualized via staining with Neutral Red dye and counted. The left lung lobe was stored in 10% phosphate buffered formalin for 7 days prior to removal from the BSL3 for processing. After paraffin embedding, sectioning and staining histopathological scoring was performed.

For vaccination and neutralization experiments, mice were vaccinated with Venezuelan equine encephalitis virus strain 3526 based replicon particles (VRPs) expressing SARS-CoV-2 spike (S), nucleocapsid (N), or GFP as control. VRPs were given via hind footpad injection at a dose of $10^3$ in 104. The same strategy was used to boost mice 3 weeks post prime and presence of neutralizing antibodies was confirmed in submandibular bleeds at the time of boost.

Authentic virus neutralization of sera from 3 weeks post boost using nanoLuciferase-expressing SARS-CoV-2 virus (SARS-CoV-2 nLuc), bearing wild-type spike protein, was performed as described with slight modification. Briefly, Vero E6 cells were seeded at $2 \times 10^4$ cells/well in a 96-well plate 24h before the assay. 100 PFUs of SARS-CoV-2-nLuc virus were mixed with serial diluted sera at 1:1 ratio and incubated at 37° C. for 1 h. A 8-point, 3-fold dilution curve was generated for each sample with starting concentration at 1:20. Virus and Ab mix was added to cells and incubated at 37° C. +5% $CO_2$ for 48h. Luciferase activities were measured by Nano-Glo Luciferase Assay System (Promega, Wis.) following manufacturer protocol using SpectraMax M3 luminometer (Molecular Device). Percent inhibition and 50% inhibition concentration ($IC_{50}$) were calculated by the following equation: [1-(RLU with sample/RLU with mock treatment)]×100%. Fifty percent inhibition titer ($IC_{50}$) was calculated in GraphPad Prism 8.4.2 by fitting the data points using a sigmoidal dose-response (variable slope) curve.

Intranasal challenge of anesthetized (ketamine/xylazine) mice with $10^4$ PFU SARS-CoV-2 MA10 was performed 4 weeks post boost. Changes in body weight and alterations in lung function parameters were recorded daily and mice were euthanized by isoflurane overdose for harvests on day 2 and day 4 after infection. Viral titers in lungs were analyzed via plaque assay.

Figure 11:
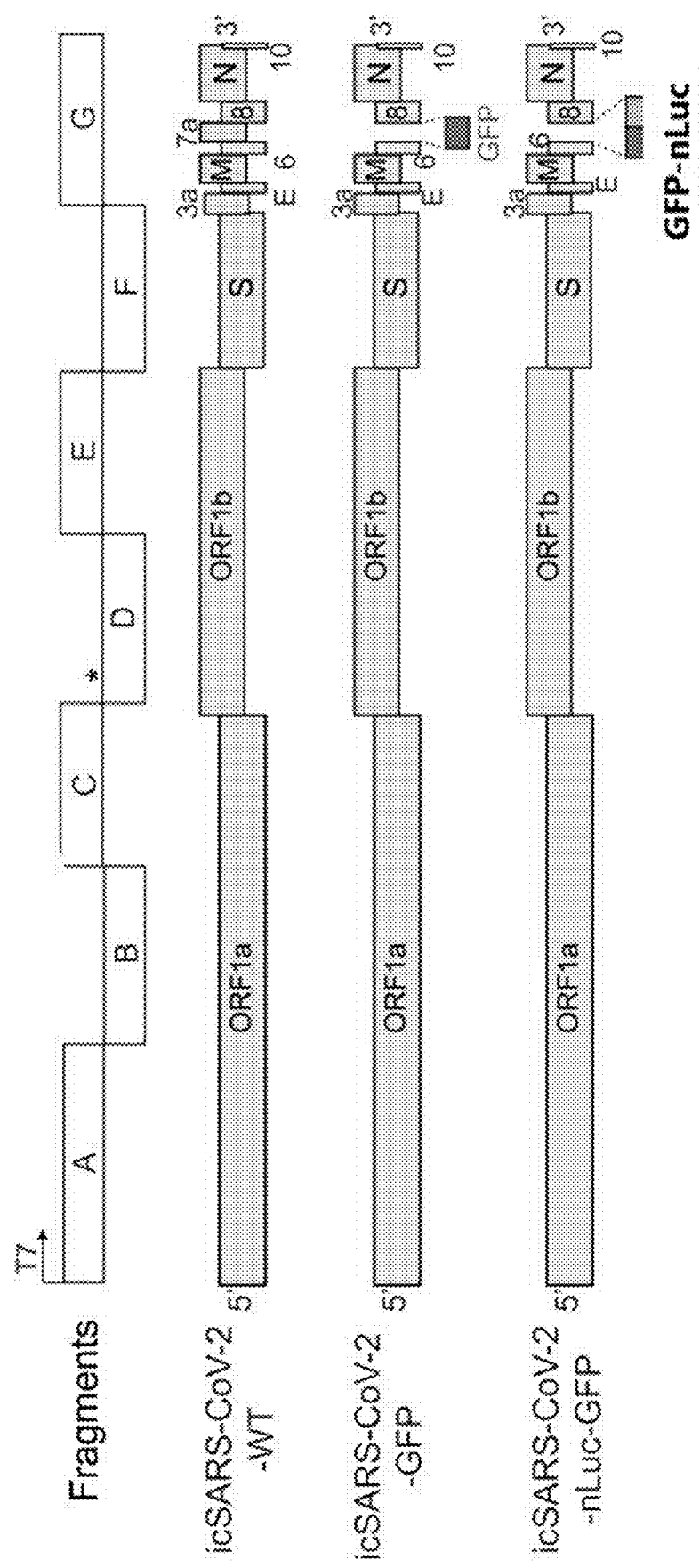
FIG. 11 shows a schematic of full-length cDNA clone constructs and genomes of recombinant viruses. Restriction sites, cohesive ends, and the genetic marker T15102A (*) are indicated in the schematic diagram. GFP or GFP-fused nLuc genes were introduced into the ORF7 (replacing amino acids 14-104) of SARS-CoV-2 genome.

Example 3: Development of Reverse Genetics System for SARS-CoV-2 and Generation of Reporter Viruses Recombinant viruses replicate similarly to the SARS-CoV-2 clinical isolate in vitro. A full-length infectious complementary DNA (cDNA) clone of a US SARS-CoV-2 clinical isolate WA1 was generated by cloning seven genomic fragments separately into vector plasmids (FIG. 11). Additionally, two reporter viruses were constructed by replacing a 276-bp region in ORF7 with a green fluorescent protein (GFP) or a GFP-fused nanoluciferase (nLuc) gene. After assembly into full-length cDNA, full-length RNA was electroporated into Vero-E6 cells. After recovering the wild-type (WT), icSARS-CoV-2-GFP, and icSARS-CoV-2-nLuc-GFP recombinant viruses, viral replication was confirmed by the presence of sub-genomic-length leader-containing RNA transcripts 20 h after electroporation. All three recombinant viruses replicated, generated similar plaques in Vero E6 cells, and could be passaged serially in the cell culture without exogenous trypsin. We defined cytopathic effect (CPE) by cell rounding and detachment from monolayers. GFP signals were evident in cells two days after transfection with RNA transcripts from both indicator viruses.

Figure 12:
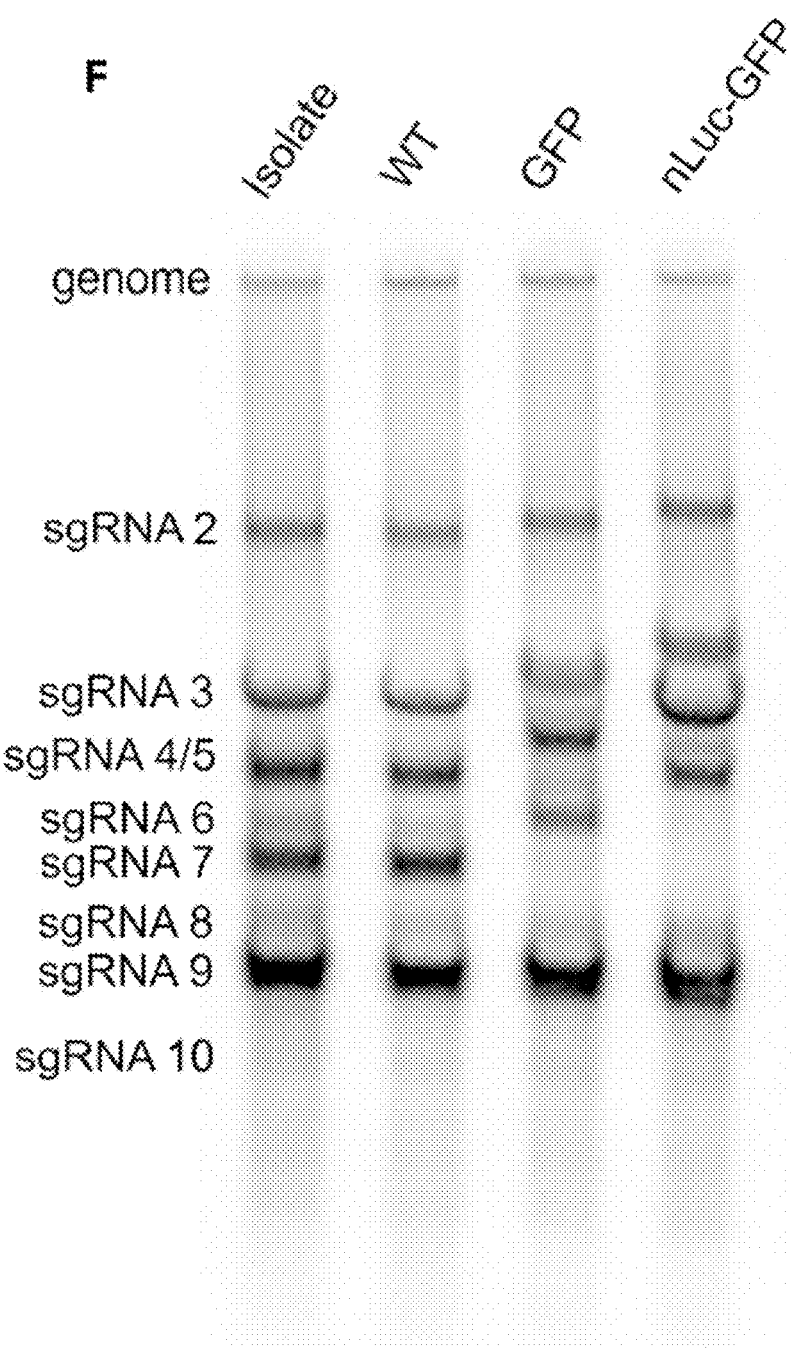
FIG. 12 shows an image of northern blot analysis of genomic and sgRNAs isolated from the virus infected cells. Abbreviations are as follows: Isolate, clinical isolate strain WA1; WT, icSARS-CoV-2-WT; GFP; icSARS-CoV-2-GFP; nLuc-GFP; icSRS-CoV-2-nLuc-GFP.

To distinguish our recombinant viruses from the circulating SARS-CoV-2 strains, we introduced a silent mutation (T15102A) into a conserved region in nsp12 to ablate an endogenous SacI site in the molecular clone. We confirmed the presence of this mutation in all three recombinant viruses but not in the clinical SARS-CoV-2 isolate via Sanger sequencing and PCR amplification followed by SacI digestion. To evaluate viral RNA synthesis, we performed Northern blot analyses that showed that the number of sub-genomic RNA (sgRNA) bands was equivalent in the recombinant and clinical isolates, confirming the presence of eight principle sub-genomic mRNAs during infection (FIG. 12). As expected, the molecular weights of sgRNA 2 to sgRNA 7 in the two reporter viral samples were higher than those in the clinical isolate and WT samples, reflecting the insertion of the 720-bp GFP gene or the 1,233-bp nLuc-GFP gene into the 366-bp ORF7 genetic location. These data also demonstrated that ORF7 was not essential for in vitro replication of SARS-CoV-2.

Figure 13A:
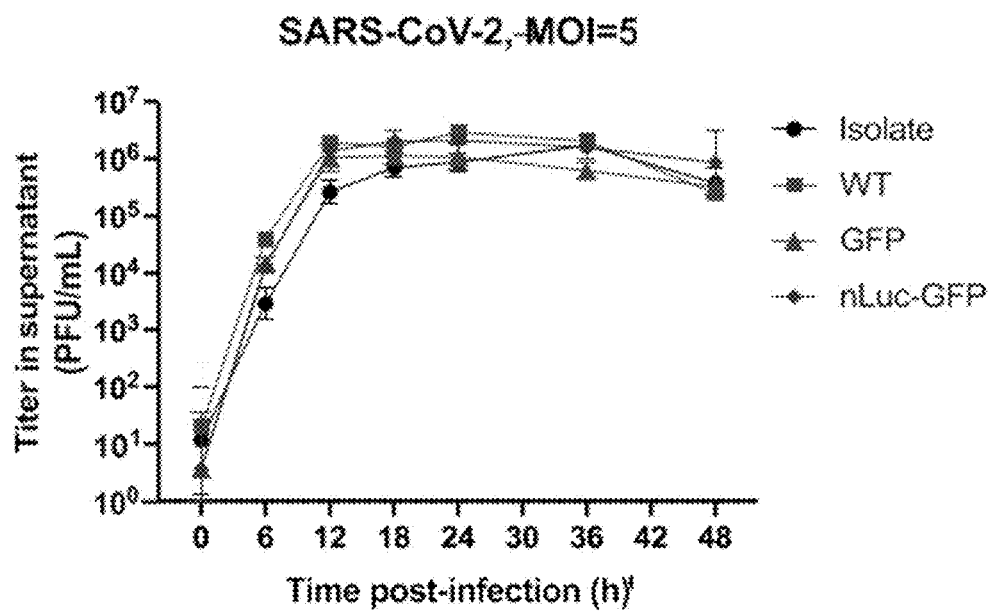
FIGS. 13A-13B show plots of one step (FIG. 13A) and multi-step (FIG. 13B) growth curves of clinical isolate and recombinant viruses in Vero E6 cells, with MOI of 5 and 0.05, respectively.
Figure 13B:
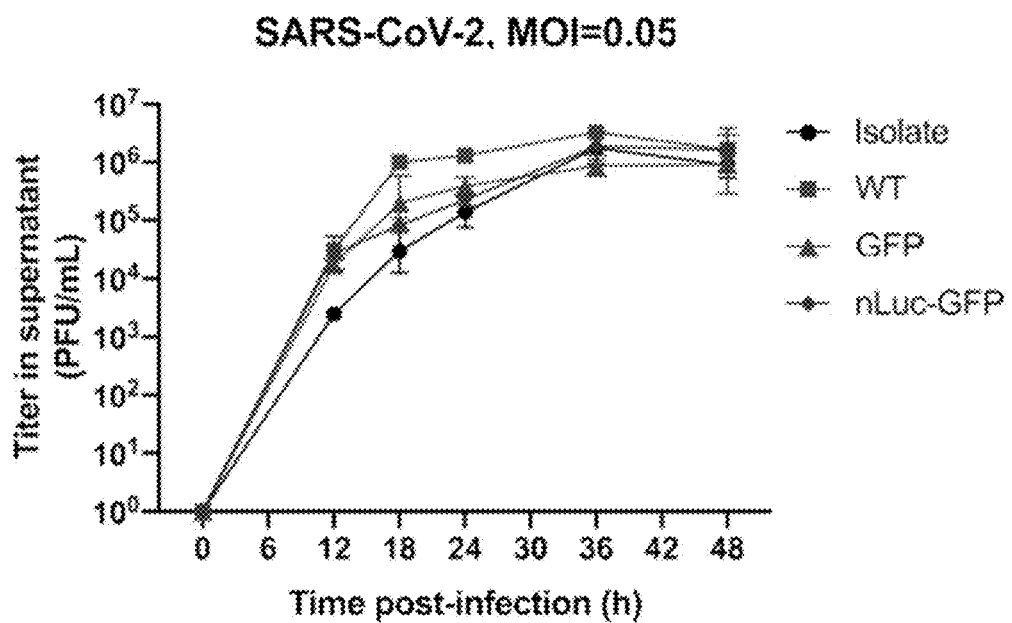

Next, we evaluated one-step (multiplicity of infection [MOT]=5) and multi-step (MOI=0.05) growth curves of the three recombinant viruses in Vero E6 cells in comparison to the clinical isolate WA1 strain. The titer of all SARS-CoV-2 increased and plateaued to mid-$10^6$ plaque-forming units (PFU)/mL within 12-18 h in the one-step curve and within 36-48 h in the multi-step curve (FIGS. 13A-13B). In contrast to other reported indicator viruses, the three recombinant viruses replicated to titers equivalent to the clinical isolate.

Host proteases, including cell surface and intracellular proteases, play an essential role in CoV infection by processing the S protein to trigger membrane fusion. Therefore, we evaluated the multi-step replication (MOI=0.03) of the icSARS-CoV-2-GFP in the presence of selected proteases via fluorescence microscopy and measurements of viral titer. Vero cells were infected with the icSARS-CoV-2-GFP reporter virus in the presence of 0, 1, or 5 mg/mL of trypsin. Unlike some coronaviruses (CoVs), trypsin did not trigger syncytium formation, and at 24 and 48 h, a slightly higher percentage of trypsin-exposed cells expressed GFP signals and CPE than did controls. Trypsin also resulted in slightly lower virus titers than controls, suggesting that trypsin impairs the stability of viral particles in supernatants.

SARS-CoV-2 S protein exhibits a novel 4 amino acid (aa) furin-cleavage site "RRAR" at the junction between S1 and S2 sub-units. We observed increased icSARS-CoV-2-GFP expression in the furin-overexpressing versus WT cells at 24 h, correlating with 1 log 10 higher infectious titers than WT Vero cells at early times after infection. Moreover, extensive CPE was noted in furin cells versus parental Vero cell cultures. In contrast, enhanced expression of TMPRSS2 in a rhesus monkey kidney epithelial cell line, LLC-MK cells, resulted in higher amounts of GFP expression and higher icSARS-CoV-2-GFP titers. These data suggest that serine proteases like furin and TMPRSS2 enhance the replication efficiency and cytopathology of SARS-CoV-2 in vitro.

Figure 14:
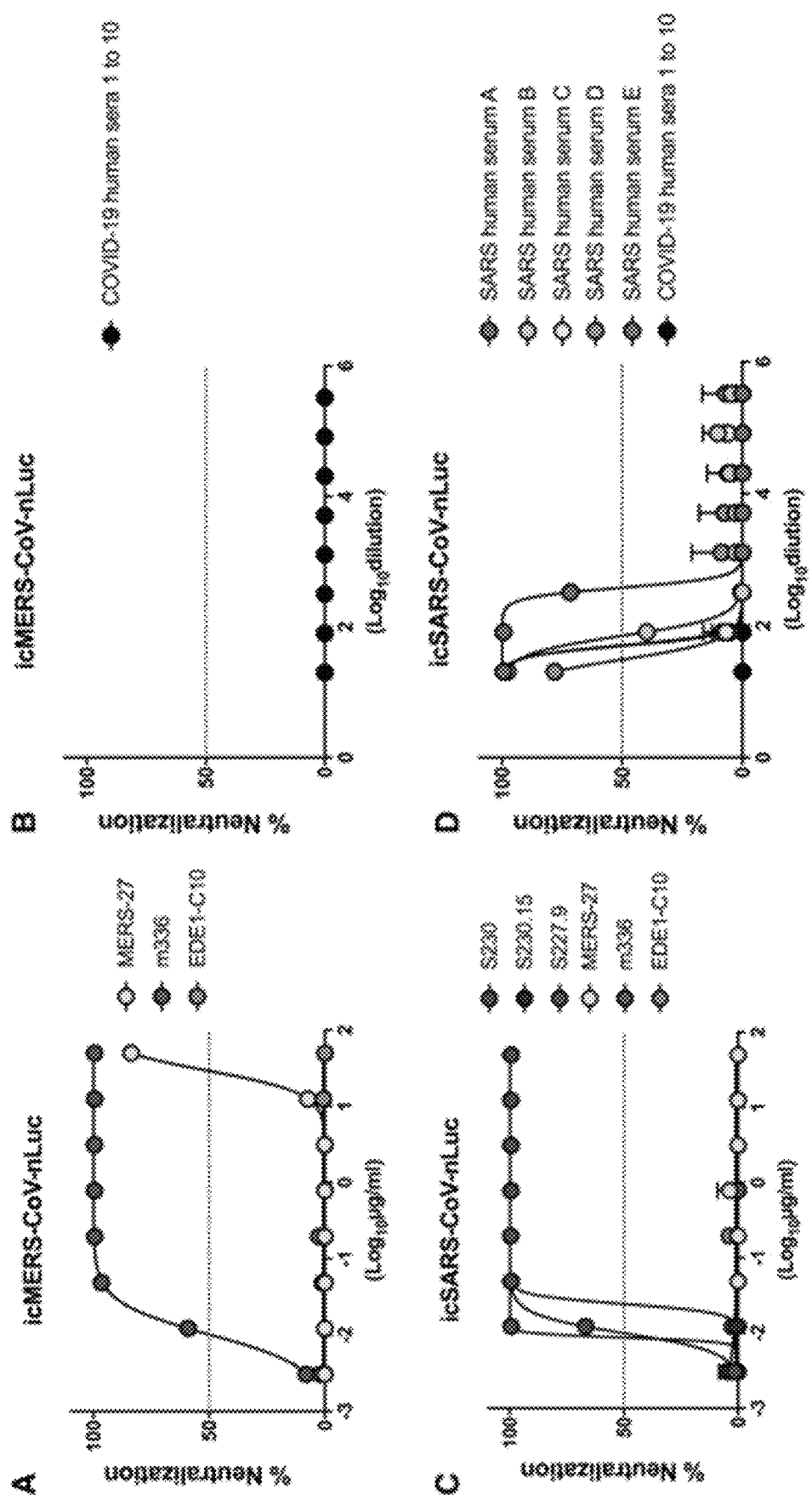
FIG. 14 shows data plots from neutralization assays using luciferase reporter coronaviruses.
Figure 14:
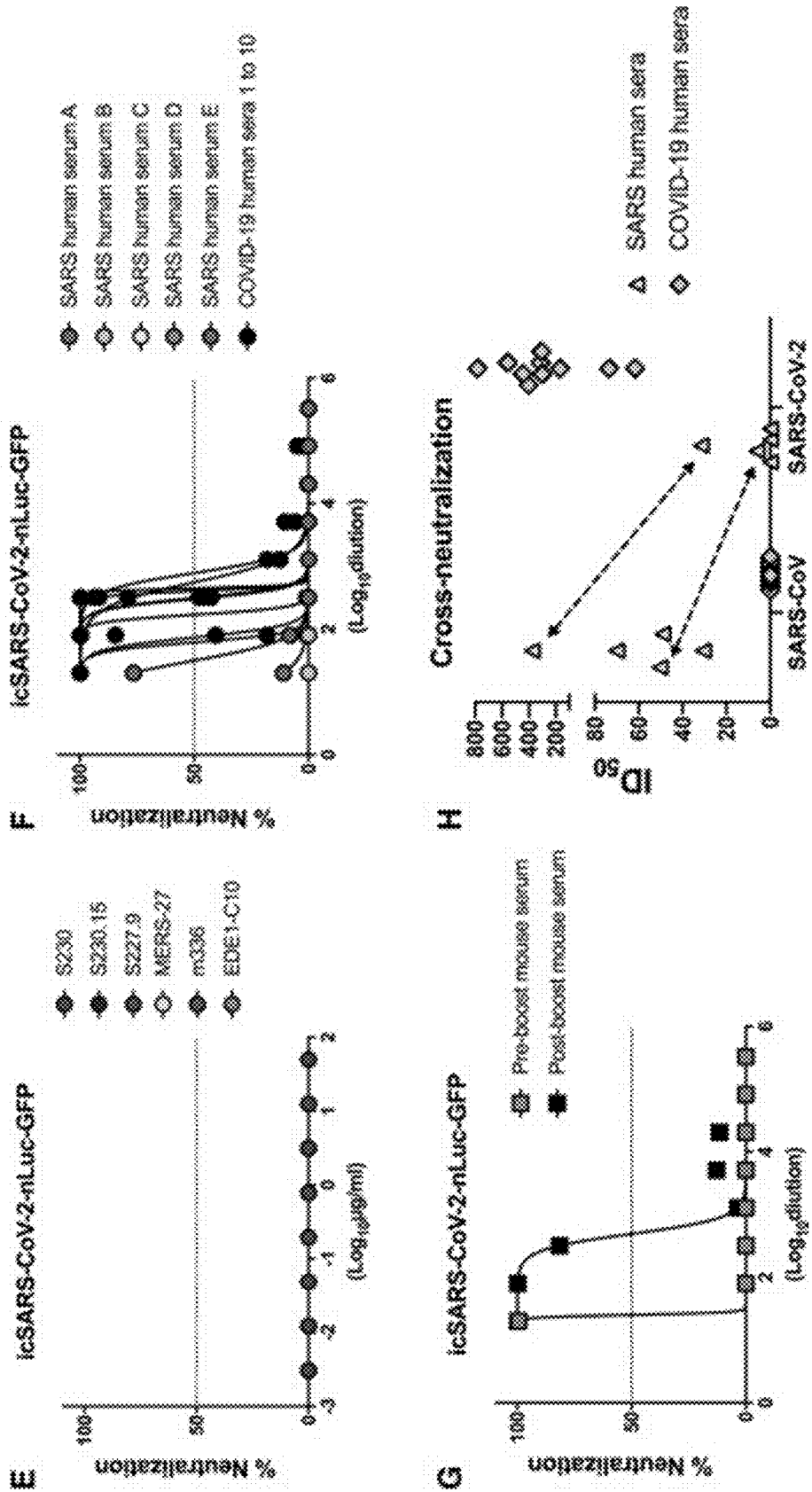

The neutralization sensitivity of SARS-CoV-2 nLuc virus to potent SARS and MERS monoclonal antibodies and polyclonal sera. Three neutralization assays were developed utilizing luciferase reporter CoVs, including SARS-CoV, MERS-CoV, and SARS-CoV-2 (FIG. 14 panels A-H). Previous studies have identified remarkably potent SARS and MERS nAbs that target receptor binding domains and exhibit strong neutralizing activities in vitro and in vivo. We utilized three highly cross-reactive nAb against SARS-CoV (S230, 5230.15, and S227.9), two nAbs against MERS-CoV (MERS-27 and m336), and one broadly cross-reactive nAb against dengue virus (EDE1-C10). We also tested a pooled mouse serum sample collected from BALB/c mice vaccinated and boosted with a Venezuelan equine encephalitis virus viral replicon particle (VRP-SARS-COV-2-S) encoding the SARS-CoV-2 S gene. The boost was performed three weeks after vaccination, and sera were collected one week before and one week after boost.

Both the MERS nAbs, MERS-27 and m336, neutralized the icMERS-CoV-nLuc virus but not the 2003 SARS-CoV-nLuc or 2019 SARS-CoV-2-nLuc-GFP recombinant viruses. Similarly, the three SARS nAbs, 5230, 5230.15, and 5227.9 exhibited potent neutralization activities against icSARS-CoV-nLuc, but not icSARS-CoV-2-nLuc-GFP (FIG. 14 panels A, C, and E). As a negative control, a dengue virus nAb EDE1-C10 did not neutralize any of the three tested CoVs. Importantly, the mouse serum sample neutralized 99.4% of the icSARS-CoV-2-nLuc-GFP virus at a 1:2 dilution after prime, and much more potent neutralization was noted after VRP-SARS-CoV-2-S boost (FIG. 14 panel G).

Bacterial and Virus Strains and Deposited Data
  SARS-CoV-2 WA1 isolate: GenBank: MT020880
  icSARS-CoV-2-WT: GenBank: MT461669
  icSARS-CoV-2-GFP: GenBank: MT461670
  icSARS-CoV-2-nLuc-GFP: GenBank: MT461671
  icSARS-CoV-2 WT genomic sequence: MT461669
  icSARS-CoV-2-GFP genomic sequence: MT461670
  icSARS-CoV-2-nLuc-GFP genomic sequence: MT461671
Primers:
  Leader forward primer (SEQ ID NO:46):
  50-GTTTATACCTTCCCAGGT AACAAACC-30
  M gene reverse primer (SEQ ID NO:47):
  50-AAGAAGCAATGAAGTA GCTGAGCC-30
  N gene primer (SEQ ID NO:48):
  50-GTAGAAATACCATCTTGGACT GAGATC-30
  RT-PCR primer (SEQ ID NO:49):
  50-GCTTCTGGTAATCTATTACTAG ATAAACG-30
  RT-PCR primer (SEQ ID NO:50):
  50-AAGACATCAGCATACTCCTG ATTAGG-30
  biotin-labeled oligomer (SEQ ID NO:51):
  50-BiodT/GGCTCTGTTGGGA ATGTTTTGTATGCG/BiodT-30

Clinical SARS-CoV-2 isolate WA1 strain was used (GenBank Accession #: MT020880). Recombinant CoVs icSARS-CoV-Urbani, icSARS-CoV-GFP, icSARS-CoV-nLuc and icMERS-CoV-nLuc were generated in our laboratory. Briefly, the strategy to synthesize full-length cDNA clones for SARS-CoV-Urbani and MERS-CoV was identical to the method reported herein, but with different restriction sites and junctions. The GFP and nLuc reporters were inserted into the accessory ORF7a of the icSARS-CoV-Urbani clone, whereas the nLuc reporter gene was introduced into the accessory ORF5a of the icMERS-CoV clone. Virus stocks were propagated on Vero E6 cells in minimal essential medium containing 10% fetal bovine serum (HyClone) and supplemented with penicillin/kanamycin (Gibco). Virus plaques were visualized by neutral red staining at two days post-infection.

Assembly of SARS-CoV-2 WT and reporter cDNA constructs. Seven cDNA fragments covering the entire SARS-CoV-2 WA1 genome were amplified by RT-PCR using PrimeSTAR GXL HiFi DNA polymerase (TaKaRa). Junctions between each fragment contain non-palindromic sites BsaI (GGTCTCN^NNNN; SEQ ID NO:52) or BsmBI (CGTCTCN^NNNN: SEQ ID NO:53) with unique four-nucleotide cohesive ends. Fragment E and F contains two BsmBI sites at both termini, while other fragments harbor BsaI sites at the junction. To assist the transcription of full-length viral RNA, we introduced a T7 promoter sequence into the upstream of fragment A, as well as a 25nt poly-A tail into the downstream of the fragment G. Each fragment was cloned into high-copy vector pUC57 and verified by Sanger sequencing. A silent mutation T15102A was introduced into a conserved region in nsp12 in plasmid D as a genetic marker. To enhance the efficiency of recovering SARS-CoV-2 virus in the cell culture, a sgRNA-N construct, encoding a 75nt leader sequence, N gene, 30UTR, and a 25nt poly-A tail, was assembled under the control of a T7 promoter. Two reporter viruses, one containing GFP and the other harboring, a GFP-fused nLuc gene, were generated by replacing the ORF7 gene with the reporter genes.

Generation of full-length RNA transcript and recovery of recombinant viruses. Seven genomic cDNA fragments were digested with appropriate endonucleases, resolved on 0.8% agarose gels, excised and purified using a QIAquick Gel Extraction kit (QIAGEN). A full-length genomic cDNA was obtained by ligating seven fragments in an equal molar ratio with T4 DNA ligase (NEB). We then purified the ligated cDNA with chloroform and precipitated it in isopropanol. The full-length viral RNA or SARS-CoV-2 sgRNA-N were synthesized using the T7 mMESSAGE mMACHINE T7 transcription kit (Thermo Fisher) at 30° C. for 4 h. The full-length SARS-CoV-2 transcript and sgRNA-N were mixed and electroporated into 8 3 106 of Vero E6 cells. The cells were cultured as usual in the medium for two to three days.

MERS-CoV, SARS-CoV, and SARS-CoV-2 neutralization assays. Recombinant viruses icMERS-CoV-nLuc, icSARS-CoV-nLuc, and icSARS-CoV-2-nLuc-GFP were tittered in Vero E6 cells to obtain a relative light unit (RLU) signal of at least 20× the cell only control background. Vero E6 cells were plated at 20,000 cells per well the day prior in clear bottom black-walled 96-well plates (Corning 3904). Neutralizing antibody serum samples were tested at a starting dilution of 1:20 and mAb samples were tested at a starting dilution of 50 mg/mL and were serially diluted 4-fold up to eight dilution spots. icMERS-CoV-nLuc, icSARS-CoV-nLuc, and icSARS-CoV-2-nLuc-GFP viruses were diluted and were mixed with serially diluted antibodies. Antibody-virus complexes were incubated at 37° C. with 5% $CO_2$ for 1 h. Following incubation, growth medium was removed, and virus-antibody dilution complexes were added to the cells in duplicate. Virus-only controls and cell-only controls were included in each neutralization assay plate. Following infection, plates were incubated at 37° C. with 5% $CO_2$ for 48 h. After the 48 h incubation, cells were lysed, and luciferase activity was measured via Nano-Glo Luciferase Assay System (Promega) according to the manufacturer specifications. MERS-CoV, SARS-CoV, and SARS-CoV-2 neutralization titers were defined as the sample dilution at which a 50% reduction in RLU was observed relative to the average of the virus control wells.

Example 4: Additional Mouse-Adapted Recombinant Viruses Generated

Additional mouse-adapted viruses were generated according to the methods described in Examples 1-3. These strains are described in Tables 1-3 and identified in the Sequence Listing provided herewith as SEQ ID NOs:16-40.

TABLE 1

Nucleotide substitutions and corresponding amino acid residue substitutions of this invention.

| Mutation(s) | Gene/Protein | AA coding change | NB: |
|---|---|---|---|
| C23054T, A23056C | spike | Q498Y | SARS-CoV-2 MA (Ex. 1) |
| C23057A, C23059G | spike | P499T | SARS-CoV-2 MA (Ex. 1) |
| C23039A | spike | Q493K | MA10 (Ex. 2) |
| C9438T | nsp4 | T285I | MA10 (Ex. 2) |
| C9491T | nsp4 | H313Y | MA10 (Ex. 2) |
| G9479T | nsp4 | G309C | MA10 (Ex. 2) |
| A11847G | nsp7 | K2R | MA10 (Ex. 2) |
| A12159G | nsp8 | E23G | MA10 (Ex. 2) |
| A12658G | nsp8 | Silent | MA10 (Ex. 2) |
| A12678G | nsp8 | K196R | MA10 (Ex. 2) |
| A12884G | nsp9 | T67A | MA10 (Ex. 2) |
| A13003G | nsp9 | Silent | MA10 (Ex. 2) |
| T27221C | ORF6 | F75 | MA10 (Ex. 2) |
| G28423A | nucleocapsid | Silent | MA10 (Ex. 2) |

TABLE 2

Non-limiting list of substitutions generated during passaging of mouse-adapted recombinant SARS-CoV-2 viruses, wherein the nucleotide position numbering is based on the reference nucleotide sequence of SEQ ID NO: 1 (GenBank MT020880).

| Nucleotide Position | Original Nucleotide | New Nucleotide | Gene | Original AA | New AA |
|---|---|---|---|---|---|
| 568 | U | C | nsp1 | G | Silent |
| 1348 | C | U | nsp2 | P | Silent |
| 5483 | A | C | nsp3 | N | H |
| 9180 | C | U | nsp4 | S | F |
| 9438 | C | U | | T | I |
| 9479 | G | T | | G | C |
| 9491 | C | U | | H | Y |
| 9519 | U | C | | F | S |
| 9618 | A | G | | N | S |
| 9924 | C | U | | A | V |
| 9962 | C | T | | H | Y |
| 10934 | U | C | nsp5 | F | L |
| 11460 | C | U | nsp6 | S | F |
| 11600 | A | G | | I | V |
| 11758 | C | T | | P | Silent |
| 11790 | U | C | | I | T |
| 11847 | A | G | nsp7 | K | R |
| 12159 | A | G | nsp8 | E | G |
| 12658 | A | G | | L | Silent |
| 12678 | A | G | | K | R |
| 12878 | A | G | nsp9 | I | V |
| 12884 | A | G | | T | A |
| 12949 | A | G | | L | Silent |
| 13003 | A | G | | L | Silent |
| 13015 | A | G | | V | Silent |
| 13024 | A | G | | Q | Silent |
| 13131 | A | G | nsp10 | Q | R |

TABLE 2-continued

Non-limiting list of substitutions generated during passaging of mouse-adapted recombinant SARS-CoV-2 viruses, wherein the nucleotide position numbering is based on the reference nucleotide sequence of SEQ ID NO: 1 (GenBank MT020880).

| Nucleotide Position | Original Nucleotide | New Nucleotide | Gene | Original AA | New AA |
|---|---|---|---|---|---|
| 17338 | G | A | nsp13 | A | T |
| 18568 | C | T | nsp14 | L | F |
| 20326 | G | A | nsp15 | V | I |
| 23039 | C | A | S | Q | K |
| 23586 | A | G |  | Q | R |
| 23606 | C | U |  | R | W |
| 23914 | A | G |  | Q | Silent |
| 25708 | C | U | ORF3a | L | F |
| 26133 | C | U |  | H | Silent |
| 26256 | C | U | E | F | Silent |
| 27210 | U | C | ORF6 | H | Silent |
| 27221 | U | C |  | F | S |
| 28423 | G | A | N | A | Silent |
| 28472 | C | U |  | P | S |
| 28815 | A | U |  | Q | L |
| 28823 | U | G |  | S | A |
| 28948 | C | U |  | D | Silent |

TABLE 3

Substitutions in additional mouse-adapted virus strains associated with Example 4.

| Mouse-adapted Virus Isolate | Nucleotide Change |
|---|---|
| MA10.1.1 | U568C |
|  | C9962T |
|  | A12658G |
|  | A12678G |
|  | A12884G |
|  | A13003G |
|  | C23039A |
|  | C23054T |
|  | A23056C |
|  | C23057A |
|  | C23059G |
|  | U27221C |
| MA10.1.2 | U568C |
|  | C9962T |
|  | A12658G |
|  | A12678G |
|  | A12884G |
|  | A13003G |
|  | C23054T |
|  | A23056C |
|  | C23057A |
|  | C23059G |
|  | C23039A |
|  | C26133U |
|  | U27221C |
| MA10.1.3 | U568C |
|  | C9962T |
|  | C11460U |
|  | A12878G |
|  | A12884G |
|  | A12949G |
|  | A13003G |
|  | A13015G |
|  | A13024G |
|  | C18568T |
|  | C23054T |
|  | A23056C |
|  | C23057A |
|  | C23059G |
|  | C23039A |
|  | U27221C |
| MA10.1.4 | U568C |
|  | C9962T |
|  | A12658G |
|  | A12678G |
|  | A12884G |
|  | A13003G |
|  | C23054T |
|  | A23056C |
|  | C23057A |
|  | C23059G |
|  | C23039A |
|  | U27221C |
|  | C28472U |
| MA10.1.5 | C9962T |
|  | A11600G |
|  | A12658G |
|  | A12678G |
|  | A12884G |
|  | A13003G |
|  | C23054T |
|  | A23056C |
|  | C23057A |
|  | C23059G |
|  | C23039A |
|  | C26256U |
|  | U27221C |
| MA10.2.1 | U11790C |
|  | A12658G |
|  | A12678G |
|  | A12884G |
|  | A13003G |
|  | C23054T |
|  | A23056C |
|  | C23057A |
|  | C23059G |
|  | C23039A |
|  | U27221C |
|  | U28823G |
| MA10.2.2 | U9519C |
|  | A12658G |
|  | A12678G |
|  | A12884G |
|  | A13003G |
|  | C23054T |
|  | A23056C |
|  | C23057A |
|  | C23059G |
|  | C23039A |
|  | U27221C |
| MA10.2.3 | U9519C |
|  | A12658G |
|  | A12678G |
|  | A12884G |
|  | A13003G |
|  | C23054T |
|  | A23056C |
|  | C23057A |
|  | C23059G |
|  | C23039A |
|  | U27221C |
| MA10.2.4 | U568C |
|  | U9519C |
|  | A12658G |
|  | A12678G |
|  | A12884G |
|  | A13003G |
|  | C23054T |
|  | A23056C |
|  | C23057A |
|  | C23059G |
|  | C23039A |
|  | U27221C |
| MA10.2.5 | C9438U |
|  | C11758T |
|  | A12658G |
|  | A12678G |
|  | A12884G |
|  | A13003G |

TABLE 3-continued

Substitutions in additional mouse-adapted virus strains associated with Example 4.

| Mouse-adapted Virus Isolate | Nucleotide Change |
|---|---|
| | C23054T |
| | A23056C |
| | C23057A |
| | C23059G |
| | C23039A |
| | U27221C |
| | A28815U |
| | C28948U |
| MA10.3.1 | C9438U |
| | A12658G |
| | A12678G |
| | A12884G |
| | A13003G |
| | C23054T |
| | A23056C |
| | C23057A |
| | C23059G |
| | C23039A |
| | U27221C |
| MA10.3.2 | C9491U |
| | A12658G |
| | A12678G |
| | A12884G |
| | A13003G |
| | C23054T |
| | A23056C |
| | C23057A |
| | C23059G |
| | C23039A |
| | U27221C |
| MA10.3.3 | G9479T |
| | A11847G |
| | A12159G |
| | C23054T |
| | A23056C |
| | C23057A |
| | C23059G |
| | C23039A |
| | U27221C |
| | G28423A |
| MA10.3.4 | C9438U |
| | A11847G |
| | A12159G |
| | C23054T |
| | A23056C |
| | C23057A |
| | C23059G |
| | C23039A |
| | U27221C |
| MA10 (as described in Leist et al. Cell 2020) | C9438U |
| | A11847G |
| | A12159G |
| | C23054T |
| | A23056C |
| | C23057A |
| | C23059G |
| | C23039A |
| | U27221C |
| MA10.4.1 | C9491U |
| | A12658G |
| | A12678G |
| | A12884G |
| | A13003G |
| | C23054T |
| | A23056C |
| | C23057A |
| | C23059G |
| | C23039A |
| | C25708U |
| | U27221C |
| MA10.4.2 | C9924U |
| | A12658G |
| | A12678G |
| | A12884G |
| | A13003G |
| | C23054T |
| | A23056C |
| | C23057A |
| | C23059G |
| | C23039A |
| | U27221C |
| MA10.4.3 | C9924U |
| | A12658G |
| | A12678G |
| | A12884G |
| | A13003G |
| | C23054T |
| | A23056C |
| | C23057A |
| | C23059G |
| | C23039A |
| | U27221C |
| MA10.4.4 | C9180U |
| | A12658G |
| | A12678G |
| | A12884G |
| | A13003G |
| | C23054T |
| | A23056C |
| | C23057A |
| | C23059G |
| | C23039A |
| | U27210C |
| | U27221C |
| MA10.4.5 | C9924U |
| | A12658G |
| | A12678G |
| | A12884G |
| | A13003G |
| | C23054T |
| | A23056C |
| | C23057A |
| | C23059G |
| | C23039A |
| | U27221C |
| MA10.5.1 | A9618G |
| | U10934C |
| | C23054T |
| | A23056C |
| | C23057A |
| | C23059G |
| | C23039A |
| | A23914G |
| MA10.5.2 | A9618G |
| | U10934C |
| | C23054T |
| | A23056C |
| | C23057A |
| | C23059G |
| | C23039A |
| | C23606U |
| | A23914G |
| MA10.5.3 | A9618G |
| | U10934C |
| | C23054T |
| | A23056C |
| | C23057A |
| | C23059G |
| | C23039A |
| | A23914G |
| | U27221C |
| MA10.5.4 | A9618G |
| | U10934C |
| | C23054T |
| | A23056C |
| | C23057A |
| | C23059G |
| | C23039A |
| | A23914G |

TABLE 3-continued

Substitutions in additional mouse-adapted virus strains associated with Example 4.

| Mouse-adapted Virus Isolate | Nucleotide Change |
|---|---|
| MA10.5.5 | A5483C |
| | A9618G |
| | U10934C |
| | G20326A |
| | C23054T |
| | A23056C |
| | C23057A |
| | C23059G |
| | C23039A |
| | A23914G |

SEQUENCE LISTING (53 sequences)

SEQ ID NO: 1 - DNA, 29882 bp, Unknown
  coronavirus SARS-CoV-2 Genbank MT020880
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaa

SEQ ID NO: 2 - protein, 1273 aa, Unknown
  SARS-CoV-2 spike
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 3 - protein, 500 aa, Unknown
  SARS-CoV-2 nsp4
KIVNNWLKQLIKVTLVFLFVAAIFYLITPVHVMSKHTDFSSEIIGYKAIDGGVTRDIASTDTCFANKHADFDTWFSQRGGSYTNDKACPLIAAVITREVGFVVPGLPGTILRTTNGDFLHFLPRVFSAVGNICYTPSKLIEYTDFATSACVLAAECTIFKDASGKPVPYCYDTNVLEGSVAYESLRPDTRYVLMDGSIIQFPNTYLEGSVRVVTTFDSEYCRHGTCERSEAGVCVSTSGRWVLNNDYYRSLPGVFCGVDAVNLLTNMFTPLIQPIGALDISASIVAGGIVAIVVTCLAYYFMRFRRAFGEYSHVVAFNTLLFLMSFTVLCLTPVYSFLPGVYSVIYLYLTFYLTNDVSFLAHIQWMVMFTPLVPFWITIAYIICISTKHFYWFFSNYLKRRVVFNGVSFSTFEEAALCTFLLNKEMYLKLRSDVLLPLTQYNRYLALYNKYKYFSGAMDTTSYREAACCHLAKALNDFSNSGSDVLYQPPQTSITSAVLQ

SEQ ID NO: 4 - protein, 83 aa, Unknown
  SARS-CoV-2 nsp7
SKMSDVKCTSVVLLSVLQQLRVESSSKLWAQCVQLHNDILLAKDTTEAFEKMVSLLSVLLSMQGAVDINKLCEEMLDNRATLQ

SEQ ID NO: 5 - protein, 198 aa, Unknown
  SARS-CoV-2 nsp8
AIASEFSSLPSYAAFATAQEAYEQAVANGDSEVVLKKLKKSLNVAKSEFDRDAAMQRKLEKMADQAMTQMYKQARSEDKRAKVTSAMQTMLFTMLRKLDNDALNNIINNARDGCVPLNIIPLTTAAKLMVVIPDYNTYKNTCDGTTFTYASALWEIQQVVDADSKIVQLSEISMDNSPNLAWPLIVTALRANSAVKLQ

SEQ ID NO: 6 - protein, 113 aa, Unknown
  SARS-CoV-2 nsp9
NNELSPVALRQMSCAAGTTQTACTDDNALAYYNTTKGGRFVLALLSDLQDLKWARFPKSDGTGTIYTELEPPCRFVTDTPKGPKVKYLYFIKGLNNLNRGMVLGSLAATVRLQ

SEQ ID NO: 7 - protein, 61 aa, Unknown
  SARS-CoV-2 ORF6
MFHLVDFQVTIAEILLIIMRTFKVSIWNLDYIINLIIKNLSKSLTENKYSQLDEEQPMEID

SEQ ID NO: 8 - DNA, 29882 bp, Artificial Sequence
  2019-nCoV/USA-WA1-A12/2020 MA10
auuaaagguuuauaccuucccagguaacaaaccaaccaacuuucgaucucuuguagaucuguucucuaaacgaacuuuaaaaucuguguggcugucacucggcugcaugcuuagugcacucacgcaguauaauuaauaacuaauuacugucguugacaggacacgaguaacucgucuaucuucugcaggcugcuuacgguuucguccguguugcagccgaucaucagcacaucuagguuucguccgggugugaccgaaagguaagauggagagccuugucccugguuucaacgagaaaacacacguccaacucaguuugccuguuuuacagguucgcgacgugcucguacguggcuuuggagacuccguggaggaggucuuaucagaggcacgucaacaucuuaaagauggcacuuguggcuuaguagaaguugaaaaaggcguuuugccucaacuugaacagcccuauguguucaucaaacguucggaugcucgaacugcaccucauggucauguuaugguugagcugguagcagaacucgaaggcauucaguacggucguaguggugagacacuugguguccuugucccucaugugggcgaaauaccaguggcuuaccgcaagguucuucuucguaagaacgguaauaaaggagcugguggccauaguuacggcgccgaucuaaagucauuugacuuaggcgacgagcuuggcacugauccuuaugaagauuuucaagaaaacuggaacacuaaacauagcagugguguuacccgugaacucaugcgugagcuuaacggaggggcauacacucgcuaugucgauaacaacuucuguggcccugauggcuacccucuugagugcauuaaagaccuucuagcacgugcugguaaagcuucaugcacuuuguccgaacaacuggacuuuauugacacuaagagggguguauacugcugccgugaacaugagcaugaaauugcuugguacacggaacguucugaaaagagcuaugaauugcagacaccuuuugaaauuaaauuggcaaagaaauuugacaccuucaauggggaauguccaaauuuuguauuucccuuaaauuccauaaucaagacuauucaaccaaggguugaaaagaaaaagcuugauggcuuuauggguagaauucgaucugucuauccaguugcgucaccaaaugaaugcaaccaaaugugccuuucaacucucaugaagugugaucauuguggugaaacuucauggcagacgggcgauuuuguuaaagccacuugcgaauuuuguggcacugagaauuugacuaaagaaggugccacuacuugugguuacuuaccccaaaaugcuguuguuaaaauuuauuguccagcaugucacaauucagaaguaggaccugagcauagucuugccgaauaccauaaugaaucuggcuugaaaaccauucuucguaaggguggucgcacuauugccuuuggaggcuguguguucucuuauguugguugccauaacaagugugccuauuggguuccacgugcuagcgcuaacauagguuguaaccauacagguguuguuggagaagguuccgaaggucuuaaugacaaccuucuugaaauacuccaaaaagagaaagucaacaucaauauuguuggugacuuuaaacuuaaugaagagaucgccauuauuuuggcaucuuuuucugcuuccacaagugcuuuuguggaaacugugaaagguuuggauuauaaagcauucaaacaaauuguugaauccugugguaauuuuaaaguuacaaaaggaaaagcuaaaaaaggugccuggaauauuggugaacagaaaucaauacugaguccucuuuaugcauuugcaucagaggcugcucguguuguacgaucaauuuucucccgcacucuugaaacugcucaaaauucugugcguguuuuacagaaggccgcuauaacaauacuagauggaauuucacaguauucacugagacucauugaugcuaugauguucacaucugauuuggcuacuaacaaucuaguuguaauggccuacauuacaggugguguuguucaguugacuucgcaguggcuaacuaacaucuuuggcacuguuuaugaaaaacucaaacccguccuugauuggcuugaagagaaguuuaaggaagguguagaguuucuuagagacgguugggaaauuguuaaauuuaucucaaccugugcuugugaaauugucgguggacaaauugucaccugugcaaaggaaauuaaggagaguguucagacauucuuuaagcuuguaaauaaauuuuuggcuuugugugcugacucuaucauuauugguggagcuaaacuuaaagccuugaauuuaggugaaacauuugucacgcacucaaagggauuguacagaaaguguguuaaauccagagaagaaacuggccuacucaugccucuaaaagccccaaaagaaauuaucuucuuagagggagaaacacuucccacagaaguguuaacagaggaaguugucuugaaaacuggugauuuacaaccauuagaacaaccuacuagugaagcuguugaagcuccauugguugguacaccaguuuguauuaacgggcuuauguugcucgaaaucaaagacacagaaaaguacugugcccuugcaccuaauaugaugguaacaaacaauaccuucacacucaaaggcggugcaccaacaaagguuacuuuuggugaugacacugugauagaagugcaagguuacaagagugugaauaucacuuuugaacuugaugaaaggauugauaaaguacuuaaugagaagugcucugccuauacaguugaacucgguacagaaguaaaugaguucgccuguguuguggcagaugcugucauaaaaacuuugcaaccaguaucugaauuacuuacaccacugggcauugauuuagaugaguggaguauggcuacauacuacuuauuugaugagucuggugaguuuaaauuggcuucacauauguauuguucuuucuacccuccagaugaggaugaagaagaaggugauugugaagaagaagaguuugagccaucaacucaauaugaguaugguacugaagaugauuaccaagguaaaccuuuggaauuuggugccacuucugcugcucuucaaccugaagaagagcaagaagaagauugguuagaugaugauagucaacaaacuguuggucaacaagacggcagugaggacaaucagacaacuacuauucaaacaauuguugagguucaaccucaauuagagauggaacuuacaccaguuguucagacuauugaagugaauaguuuuagugguuauuuaaaacuuacugacaauguauacauuaaaaaugcagacauuguggaagaagcuaaaaagguaaaaccaacagugguuguuaaugcagccaauguuuaccuuaaacauggaggagguguugcaggagccuuaaauaaggcuacuaacaaugccaugcaaguugaaucugaugauuacauagcuacuaauggaccacuuaaagugggugguaguuguguuuuaagcggacacaaucuugcuaaacacugucuucauguugucggcccaaauguuaacaaaggugaagacauucaacuucuuaagagugcuuaugaaaauuuuaaucagcacgaaguucuacuugcaccauuauuaucagcugguauuuuuggugcugacccuauacauucuuuaagaguuuguguagauacuguucgcacaaaugucuacuuagcugucuuugauaaaaaucucuaugacaaacuuguuucaagcuuuuuggaaaugaagagugaaaagcaaguugaacaaaagaucgcugagauuccuaaagaggaaguuaagccauuuauaacugaaaguaaaccuucaguugaacagagaaaacaagaugauaagaaaaucaaagcuuguguugaagaaguuacaacaacucuggaagaaacuaaguuccucacagaaaacuuguuacuuuauauugacauuaauggcaaucuucauccagauucugccacucuuguuagugacauugacaucacuuucuuaaagaaagaugcuccauauauagugggugauguuguucaagaggguguuuuaacugcugugguuauaccuacuaaaaaggcugguggcacuacugaaaugcuagcgaaagcuuugagaaaagugccaacagacaauuauauaaccacuuacccgggucaggguuuaaaugguuacacuguagaggaggcaaagacagugcuuaaaaaguguaaaagugccuuuuacauucuaccaucuauuaucucuaaugagaagcaagaaauucuuggaacuguuucuuggaauuugcgagaaaugcuugcacaugcagaagaaacacgcaaauuaaugccugucuguguggaaacuaaagccauaguuucaacuauacagcguaaauauaaggguauuaaaauacaagagggugugguugauuauggugcuagauuuuacuuuuacaccaguaaaacaacuguagcgucacuuaucaacacacuuaacgaucuaaaugaaacucuuguuacaaugccacuuggcuauguaacacauggcuuaaauuuggaagaagcugcucgguauaugagaucucucaaagugccagcuacaguuucuguuucuucaccugaugcuguuacagcguauaaugguuaucuuacuucuucuucuaaaacaccugaagaacauuuuauugaaaccaucucacuugcugguuccuauaaagauugguccuauucuggacaaucuacacaacuagguauagaauuucuuaagagaggugauaaaaguguauauuacacuaguaauccuaccacauuccaccuagauggugaaguuaucaccuuugacaaucuuaagacacuucuuucuuugagagaagugaggacuauuaagguguuuacaacaguagacaacauuaaccuccacacgcaaguuguggacaugucaaugacauauggacaacaguuugguccaacuuauuuggauggagcugauguuacuaaaauaaaaccucauaauucacaugaagguaaaacauuuuauguuuuaccuaaugaugacacucuacguguugaggcuuuugaguacuaccacacaacugauccuaguuuucuggguagguacaugucagcauuaaaucacacuaaaaaguggaaauacccacaaguuaaugguuuaacuucuauuaaaugggcagauaacaacuguuaucuugccacugcauuguuaacacuccaacaaauagaguugaaguuuaauccaccugcucuacaagaugcuuauuacagagcaagggcuggugaagcugcuaacuuuugugcacuuaucuuagccuacuguaauaagacaguaggugaguuaggugauguuagagaaacaaugaguuacuuguuucaacaugccaauuuagauucuugcaaaagagucuugaacgugguguguaaaacuuguggacaacagcagacaacccuuaaggguguagaagcuguuauguacaugggcacacuuucuuaugaacaauuuaagaaagguguucagauaccuuguacgugugguaaacaagcuacaaaauaucuaguacaacaggagucaccuuuuguuaugaugucagcaccaccugcucaguaugaacuuaagcaugguacauuuacuugugcuagugaguacacugguaauuaccaguguggucacuauaaacauauaacuucuaaagaaacuuuguauugcauagacggugcuuuacuuacaaaguccucagaauacaaagguccuauuacggauguuuucuacaaagaaaacaguuacacaacaaccauaaaaccaguuacuuauaaauuggaugguguuguuuguacagaaauugacccuaaguuggacaauuauuauaagaaagacaauucuuauuucacagagcaaccaauugaucuuguaccaaaccaaccauauccaaacgcaagcuucgauaauuuuaaguuuguaugugauaauaucaaauuugcugaugauuuaaaccaguuaacugguuauaagaaaccugcuucaagagagcuuaaaguuacauuuuucccugacuuaaauggugaugugguggcuauugauuauaaacacuacacacccucuuuuaagaaaggagcuaaauuguuacauaaaccuauuguuuggcauguuaacaaugcaacuaauaaagccacguauaaaccaaauaccugguguauacguugucuuuggagcacaaaaccaguugaaacaucaaauucguuugauguacugaagucagaggacgcgcagggaauggauaaucuugccugcgaagaucuaaaaccagucucugaagaaguaguggaaaauccuaccauacagaaagacguucuugaguguaaugugaaaacuaccgaaguuguaggagacauuauacuuaaaccagcaaauaauaguuuaaaaauuacagaagagguuggccacacagaucuaauggcugcuuauguagacaauucuagucuuacuauuaagaaaccuaaugaauuaucuagaguauuagguuugaaaacccuugcuacucaugguuuagcugcuguuaauagugucccuugggauacuauagcuaauuaugcuaagccuuuucuuaacaaaguuguuaguacaacuacuaacauaguuacacgguguuuaaaccguguuuguacuaauuauaugccuuauuucuuuacuuuauugcuacaauuguguacuuuuacuagaaguacaaauucuagaauuaaagcaucuaugccgacuacuauagcaaagaauacuguuaagagugucgguaaauuuugucuagaggcuucauuuaauuauuugaagucaccuaauuuuucuaaacugauaaauauuauaauuugguuuuuacuauuaaguguuugccuagguucuuuaaucuacucaaccgcugcuuuagguguuuuaaugucuaauuuaggcaugccuucuuacuguacugguuacagagaaggcuauuugaacucuacuaaugucacuauugcaaccuacuguacugguucuauaccuuguaguguuugucuuagugguuuagauucuuuagacaccuauccuucuuuagaaacuauacaaauuaccauuucaucuuuuaaaugggauuuaacugcuuuuggcuuaguugcagagugguuuuuggcauauauucuuuucacuagguuuuucuauguacuuggauuggcugcaaucaugcaauuguuuuucagcuauuuugcaguacauuuuauuaguaauucuuggcuuaugugguuaauaauuaaucuuguacaaauggccccgauuucagcuaugguuagaauguacaucuucuuugcaucauuuuauuauguauggaaaaguuaugugcauguuguagacgguuguaauucaucaacuuguaugauguguuacaaacguaauagagcaacaagagucgaauguacaacuauuguuaaugguguuagaagguccuuuuaugucuaugcuaauggagguaaaggcuuuugcaaacuacacaauuggaauuguguuaauugugauacauucugugcugguaguacauuuauuagugaugaaguugcgagagacuugucacuacaguuuaaaagaccaauaaauccuacugaccagucuucuuacaucguugauaguguuacagugaagaaugguuccauccaucuuuacuuugauaaagcuggucaaaagacuuaugaaagacauucucucucucauuuuguuaacuuagacaaccugagagcuaauaacacuaaagguucauugccuauuaauguuauaguuuuugaugguaaaucaaaaugugaagaaucaucugcaaaaucagcgucuguuuacuacagucagcuuaugugucaaccuauacuguuacuagaucaggcauuagugucugauguuggugauagugcggaaguugcaguuaaaauguuugaugcuuacguuaauacguuuucaucaacuuuuaacguaccaauggaaaaacucaaaacacuaguugcaacugcagaagcugaacuugcaaagaauguguccuuagacaaugucuuaucuacuuuuauuucagcagcucggcaaggguuuguugauucagauguagaaacuaaagauguuguugaaugucuuaaauugucacaucaaucugacauagaaguuacuggcgauaguuguaauaacuauaugcucaccuauaacaaaguugaaaacaugacaccccgugaccuuggugcuuguauugacuguagugcgcgucauauuaaugcgcagguagcaaaaagucacaacauugcuuugauauggaacguuaaagauuucaugucauugucugaacaacuacgaaaacaaauacguagugcugcuaaaaagaauaacuuaccuuuuaaguugacaugugcaacuacuagacaaguuguuaauguuguaacaacaaagauagcacuuaagggugguaaaauuguuaauaauugguugaagcaguuaauuaaaguuacacuuguguuccuuuuuguugcugcuauuuucuauuuaauaacaccuguucaugucaugucuaaacauacugacuuuucaagugaaaucauaggauacaaggcuauugaugguggugucacucgugacauagcaucuacagauacuuguuuugcuaacaaacaugcugauuuugacacaugguuuagccagcguggugguaguuauacuaaugacaaagcuugcccauugauugcugcagucauaacaagagaaguggguuuugucgugccugguuugccuggcacgauauuacgcacaacuaauggugacuuuuugcauuucuuaccuagaguuuuuagugcaguugguaacaucuguuacacaccaucaaaacuuauagaguacacugacuuugcaacaucagcuuguguuuuggcugcugaauguacaauuuuuaaagaugcuucugguaagccaguaccauauuguuaugauaccaauguacuagaagguucuguugcuuaugaaaguuuacgcccugacacacguuaugugcucauggauggcucuauuauucaauuuccuaacaccuaccuugaagguucuguuagagugguaacaacuuuugauucugaguacuguaggcacggcacuugugaaagaucagaagcugguguuuguguaucuacuagugguagauggguacuuaacaaugauuauuacagaucuuuaccaggaguuuucugugguguagaugcuguaaauuuacuuacuaauauguuuacaccacuaauucaaccuauuggugcuuuggacauaucagcaucuauaguagcuggugguauuguagcuaucguaguaataugccuugccuacuauuuuaugagguuuagaagagcuuuuggugaauacagucauguaguugccuuuaauacuuuacuauuccuuaugucauucacuguacucuguuuaacaccaguuuacucauucuuaccugguguuuauucuguuauuuacuuguacuugacauuuuaucuuacuaaugauguuucuuuuuuagcacauauucaguggaugguuauguucacaccuuuaguaccuuucuggauaacaauugcuuauaucauuuguauuuccacaaagcauuucuauugguucuuuaguaauuaccuaaagagacguguagucuuuaaugguguuuccuuuaguacuuuugaagaagcugcgcugugcaccuuuuuguuaaauaaagaaauguaucuaaaguugcguagugaugugcuauuaccucuuacgcaauauaauagauacuuagcucuuuauaauaaguacaaguauuuuaguggagcaauggauacaacuagcuacagagaagcugcuuguugucaucucgcaaaggcucucaaugacuucaguaacucagguucugauguucuuuaccaaccaccacaaaccucuaucaccucagcuguuuugcagagugguuuuagaaaaauggcauucccaucugguaaaguugaggguuguaugguacaaguaacuugugguacaacuacacuuaacggucuuuggcuugaugacguaguuuacuguccaagacaugugaucugcaccucugaagacaugcuuaacccuaauuaugaagauuuacucauucguaagucuaaucauaauuucuugguacaggcugguaauguucaacucaggguuauuggacauucuaugcaaaauuguguacuuaagcuuaagguugauacagccaauccuaagacaccuaaguauaaguuuguucgcauucaaccaggacagacuuuuucaguguuagcuuguuacaaugguucaccaucugguguuuaccaaugugcuaugaggcccaauuucacuauuaaggguucauuccuuaaugguucaugugguaguguugguuuuaacauagauuaugacugugucucuuuuuguuacaugcaccauauggaauuaccaacuggaguucaugcuggcacagacuuagaagguaacuuuuauggaccuuuuguugacaggcaaacagcacaagcagcugguacggacacaacuauuacaguuaauguuuuagcuugguuguacgcugcuguuauaaauggagacaggugguuucucaaucgauuuaccacaacucuuaaugacuuuaaccuuguggcuaugaaguacaauuaugaaccucuaacacaagaccauguugacauacuaggaccucuuucugcucaaacuggaauugccguuuuagauaugugugcuucauuaaaagaauuacugcaaaaugguaugaauggacguaccauauuggguagugcuuuauuagaagaugaauuuacaccuuuugauguuguuagacaaugcucagguguuacuuuccaaagugcagugaaaagaacaaucaaggguacacaccacugguuguuacucacaauuuugacuucacuuuuaguuuuaguccagaguacucaauggucuuuguucuuuuuuuuguaugaaaaugccuuuuuaccuuuugcuauggguauuauugcuaugucugcuuuugcaaugauguuugucaaacauaagcaugcauuucucuguuuguuuuuguuaccuucucuugccacuguagcuuauuuuaauauggucuauaugccugcuaguugggugaugcguauuaugacaugguuggauaugguugauacuaguuugucugguuuuaagcuaaaagacuguguuauguaugcaucagcuguaguguuacuaauccuuaugacagcaagaacuguguaugaugauggugcuaggagaguguggacacuuaugaaugucuugacacucguuuauaaaguuuauuaugguaaugcuuuagaucaagccauuuccaugugggcucuuauaaucucuguuacuucuaacuacucagguguaguuacaacugucauguuuuuggccagagguauuguuuuuauguguguugaguauugcccuauuuucuucauaacugguaauacacuucaguguauaaugcuaguuuauuguuucuuaggcuauuuuuguacuuguuacuuuggccucuuuuguuuacucaaccgcuacuuuagacugacucuugguguuuaugauuacuuaguuucuacacaggaguuuagauauaugaauucacagggacuacucccacccaagaauagcauagaugccuucaaacucaacauuaaauuguuggguguugguggcaaaccuuguaucaaaguagccacuguacagucuagaaugucagauguaaagugcacaucaguagucuuacucucaguuuugcaacaacucagaguagaaucaucaucuaaauugugggcucaauguguccaguuacacaaugacauucucuuagcuaaagauacuacugaagccuuugaaaaaaugguuucacuacuuucuguuuugcuuuccaugcagggugcuguagacauaaacaagcuuugugaagaaaugcuggacaacagggcaaccuuacaagcuauagccucagaguuuaguucccuuccaucauaugcagcuuuugcuacugcucaagaagcuuaugggcaggcuguugcuaauggugauucugaaguuguucuuaaaaaguugaagaagucuuugaauguggcuaaaucugaauuugaccgugaugcagccaugcaacguaaguuggaaaagauggcugaucaagcuaugacccaaauguauaaacaggcuagaucugaggacaagagggcaaaaguuacuagugcuaugcagacaaugcuuuucacuaugcuuagaaaguuggauaaugaugcacucaacaacauuaucaacaaugcaagagaugguuguguucccuugaacauaauaccucuuacaacagcagccaaacuaaugguugucauaccagacuauaacacauauaaaaauacgugugaugguacaacauuuacuuaugcaucagcauugugggaaauccaacagguuguagaugcagauaguaaaauuguucaacuuagugaaauuaguauggacaauucaccuaauuuagcauggccucuuauuguaacagcuuuaagggccaauucugcugucaaauuacagaauaaugagcuuaguccuguugcacuacgacagaugucuugugcugccgguacuacacaaacugcuugcacugaugacaaugcguuagcuuacuacaacacaacaaagggagguagguuuguacuugcacuguuauccgauuuacaggauuugaaaugggcuagauucccuaagagugauggaacugguacuaucuauacagaacuggaaccaccuuguagguuuguuacagacacaccuaaagguccuaaagugaaguauuuauacuuuauuaaaggauuaaacaaccuaaauagagguaugguacuugguaguuuagcugccacaguacgucuacaagcugguaaugcaacagaagugccugccaauucaacuguauuaucuuucugugcuuuugcuguagaugcugcuaaagcuuacaaagauuaucuagcuagugggggacaaccaaucacuaauuguguuaagauguuguguacacacacugguacuggucaggcaauaacaguuacaccggaagccaauauggaucaagaauccuuugguggugcaucguguugucuguacugccguugccacauagaucauccaaauccuaaaggauuuugugacuuaaaagguaaguauguacaaauaccuacaacuugugcuaaugacccuguggguuuuacacuuaaaaacacagucuguaccgucugcgguauguggaaagguuauggcuguaguugugaucaacuccgcgaacccaugcuucagucagcugaugcacaaucguuuuuaaacggguuugcgguguaagugcagcccgucuuacaccgugcggcacaggcacuaguacugaugucguauacagggcuuuugacaucuacaaugauaaaguagcugguuuugcuaaauuccuaaaaacuaauuguugucgcuuccaagaaaaggacgaagaugacaauuuaauugauucuuacuuuguaguuaagagacacacuuucucuaacuaccaacaugaagaaacaauuuauaauuuacuuaaggauuguccagcuguugcuaaacaugacuucuuuaaguuuagaauagacggugacaugguaccacauauaucacgucaacgucuuacuaaauacacaauggcagaccucgucuaugcuuuaaggcauuuugaugaagguaauugugacacauuaaaagaaauacuugucacauacaauuguugugaugaugauuauuucaauaaaaaggacugguaugauuuuguagaaaacccagauauauuacgcguauacgccaacuuaggugaacguguacgccaagcuuuguuaaaaacaguacaauucugugaugccaugcgaaaugcugguauuguugguguacugacauuagauaaucaagaucucaaugguaacugguaugauuucggugauuucauacaaaccacgccagguaguggaguuccuguuguagauucuuauuauucauuguuaaugccuauauuaaccuugaccagggcuuuaacugcagagucacauguugacacugacuuaacaaagccuuacauuaagugggauuuguuaaaauaugacuucacggaagagagguuaaaacucuuugaccguuauuuuaaauauugggaucagacauaccacccaaauuguguuaacuguuuggaugacagaugcauucugcauugugcaaacuuuaauguuuuauucucuacaguguucccaccuacaaguuuuggaccacuagugagaaaaauauuuguugaugguguuccauuuguaguuucaacuggauaccacuucagagagcuagguguuguacauaaucaggauguaaacuuacauagcucuagacuuaguuuuaaggaauuacuuguguaugcugcugacccugcuaugcacgcugcuucugguaaucuauuacuagauaaacgcacuacgugcuuuucaguagcugcacuuacuaacaauguugcuuuucaaacugucaaacccgguaauuuuaacaaagacuucuaugacuuugcugugucuaaggguuucuuuaaggaaggaaguucuguugaauuaaaacacuucuucuuugcucaggaugguaaugcugcuaucagcgauuaugacuacuaucguuauaaucuaccaacaaugugugauaucagacaacuacuauuuguaguugaaguuguugauaaguacuuugauuguuacgaugguggcuguauuaaugcuaaccaagucaucgucaacaaccuagacaaaucagcugguuuuccauuuaauaaaugggguaaggcuagacuuuauuaugauucaaugaguuaugaggaucaagaugcacuuuucgcauauacaaaacguaaugucaucccuacuauaacucaaaugaaucuuaaguaugccauuagugcaaagaauagagcacgcaccguagcuggugucucuaucuguaguacuaugaccaauagacaguuucaucaaaaauuauugaaaucaauagccgccacuagaggagcuacuguaguaauuggaacaagcaaauucuauggugguuggcacaacauguuaaaaacuguuuauagugauguagaaaacccucaccuuauggguugggauuauccuaaaugugauagagccaugccuaacaugcuuagaauuauggccucacuuguucuugcucgcaaacauacaacguguuguagcuugucacaccguuucuauagauuagcuaaugagugugcucaaguauugagugaaauggucauguguggcgguucacuauauguuaaaccagguggaaccucaucaggagaugccacaacugcuuaugcuaauaguguuuuuaacauuugucaagcugucacggccaauguuaaugcacuuuuaucuacugaugguaacaaaauugccgauaaguauguccgcaauuuacaacacagacuuuaugagugucucuauagaaauagagauguugacacagacuuugugaaugaguuuuacgcauauuugcguaaacauuucucaaugaugauacucucugacgaugcuguuguguguuucaauagcacuuaugcaucucaaggucuaguggcuagcauaaagaacuuuaagucaguucuuuauuaucaaaacaauguuuuuaugucugaagcaaaauguuggacugagacugaccuuacuaaaggaccucaugaauuuugcucucaacauacaaugcuaguuaaacagggugaugauuauguguaccuuccuuacccagauccaucaagaauccuaggggccggcuguuuuguagaugauaucguaaaaacagaugguacacuuaugauugaacgguucgugucuuuagcuauagaugcuuacccacuuacuaaacauccuaaucaggaguaugcugaugucuuucauuuguacuuacaauacauaagaaagcuacaugaugaguuaacaggacacauguuagacauguauucuguuaugcuuacuaaugauaacacuucaagguauugggaaccugaguuuuaugaggcuauguacacaccgcauacagucuuacaggcuguuggggcuuguguucuuugcaauucacagacuucauuaagauguggugcuugcauacguagaccauucuuauguuguaaaugcuguuacgaccaugucauaucaacaucacauaaauuagucuugucuguuaauccguauguuugcaaugcuccagguugugaugucacagaugugacucaacuuuacuuaggagguaugagcuauuauuguaaaucacauaaaccacccauuaguuuuccauugugugcuaauggacaaguuuuugguuuauauaaaaauacauguguugguagcgauaauguuacugacuuuaaugcaauugcaacaugugacuggacaaaugcuggugauuacauuuuagcuaacaccuguacugaaagacucaagcuuuuugcagcagaaacgcucaaagcuacugaggagacauuuaaacugucuuaugguauugcuacuguacgugaagugcugucugacagagaauuacaucuuucaugggaaguugguaaaccuagaccaccacuuaaccgaaauuaugucuuuacugguuaucguguaacuaaaaacaguaaaguacaaauaggagaguacaccuuugaaaaaggugacuauggugaugcuguuguuuaccgagguacaacaacuuacaaauuaaauguuggugauuauuuugugcugacaucacauacaguaaugccauuaagugcaccuacacuagugccacaagagcacuauguuagaauuacuggcuuauacccaacacucaauaucucagaugaguuuucuagcaauguugcaaauuaucaaaagguugguaugcaaaaguauucuacacuccagggaccaccugguacugguaagagucauuuugcuauuggccuagcucucuacuacccuucugcucgcauaguguauacagcuugcucucaugccgcuguugaugcacuaugugagaaggcauuaaaauauuugccuauagauaaauguaguagaauuauaccugcacgugcucguguagaguguuuugauaaauucaaagugaauucaacauuagaacaguaugucuuuuguacuguaaaugcauugccugagacgacagcagauauaguugucuuugaugaaauuucaauggccacaaauuaugauuugaguguugucaaugccagauuacgugcuaagcacuauguguacauuggcgacccugcucaauuaccugcaccacgcacauugcuaacuaagggcacacuagaaccagaauauuucaauucaguguguagacuuaugaaaacuauagguccagacauguuccucggaacuugucggcguuguccugcugaaauuguugacacugugagugcuuugguuuaugauaauaagcuuaaagcacauaaagacaaaucagcucaaugcuuuaaaauguuuuauaaggguguuaucacgcaugauguuucaucugcaauuaacaggccacaaauaggcgugguaagagaauuccuuacacguaacccugcuuggagaaaagcugucuuuauuucaccuuauaauucacagaaugcuguagccucaaagauuuugggacuaccaacucaaacuguugauucaucacagggcucagaauaugacuaugucauauucacucaaaccacugaaacagcucacucuuguaauguaaacagauuuaauguugcuauuaccagagcaaaaguaggcauacuuugcauaaugucugauagagaccuuuaugacaaguugcaauuuacaagucuugaaauuccacguaggaauguggcaacuuuacaagcugaaaauguaacaggacuuuuuaaagauuguaguaagguaaucacuggguuacauccuacacaggcaccuacacaccucaguguugacacuaaauucaaaacugaagguuuauguguugacauaccuggcauaccuaaggacaugaccuauagaagacucaucucuaugauggguuuuaaaaugaauuaucaaguuaaugguuacccuaacauguuuaucacccgcgaagaagcuauaagacauguacgugcauggauuggcuucgaugucgaggggugucaugcuacuagagaagcuguugguaccaauuuaccuuuacagcuagguuuuucuacagguguuaaccuaguugcuguaccuacagguuauguugauacaccuaauaauacagauuuuuccagaguuagugcuaaaccaccgccuggagaucaauuuaaacaccucauaccacuuauguacaaaggacuuccuuggaauguagugcguauaaagauuguacaaauguuaagugacacacuuaaaaaucucucugacagagucguauuugucuuaugggcacauggcuuugaguugacaucuaugaaguauuuugugaaaauaggaccugagcgcaccuguugucuaugugauagacgugccacaugcuuuuccacugcuucagacacuuaugccuguuggcaucauucuauuggauuugauuacgucuauaauccguuuaugauugauguucaacaaugggguuuuacagguaaccuacaaagcaaccaugaucuguauugucaaguccaugguaaugcacauguagcuaguugugaugcaaucaugacuaggugucuagcuguccacgagugcuuuguuaagcguguugacuggacuauugaauauccuauaauuggugaugaacugaagauuaaugcggcuuguagaaagguucaacacaugguuguuaaagcugcauuauuagcagacaaauucccaguucuucacgacauugguaacccuaaagcuauuaaguguguaccucaagcugauguagaauggaaguucuaugaugcacagccuuguagugacaaagcuuauaaaauagaagaauuauucuauucuuaugccacacauucugacaaauucacagaugguguaugccuauuuuggaauugcaaugucgauagauauccugcuaauuccauuguuuguagauuugacacuagagugcuaucuaaccuuaacuugccugguugugaugguggcaguuuguauguaaauaaacaugcauuccacacaccagcuuuugauaaaagugcuuuuguuaauuuaaaacaauuaccauuuuucuauuacucugacaguccaugugagucucauggaaaacaaguagugucagauauagauuauguaccacuaaagucugcuacguguauaacacguugcaauuuagguggugcugucuguagacaucaugcuaaugaguacagauuguaucucgaugcuuauaacaugaugaucucagcuggcuuuagcuuguggguuuacaaacaauuugauacuuauaaccucuggaacacuuuuacaagacuucagaguuuagaaaauguggcuuuuaauguuguaaauaagggacacuuugauggacaacagggugaaguaccaguuucuaucauuaauaacacuguuuacacaaaaguugaugguguugauguagaauuguuugaaaauaaaacaacauuaccuguuaauguagcauuugagcuuugggcuaagcgcaacauuaaaccaguaccagaggugaaaauacucaauaauuuggguguggacauugcugcuaauacugugaucugggacuacaaaagagaugcuccagcacauauaucuacuauugguguuuguucuaugacugacauagccaagaaaccaacugaaacgauuugugcaccacucacugucuuuuuugaugguagaguugauggucaaguagacuuauuuagaaaugcccguaaugguguucuuauuacagaagguaguguuaaagguuuacaaccaucuguaggucccaaacaagcuagucuuaauggagucacauuaauuggagaagccguaaaaacacaguucaauuauuauaagaaaguugaugguguuguccaacaauuaccugaaacuuacuuuacucagaguagaaauuuacaagaauuuaaacccaggagucaaauggaaauugauuucuuagaauuagcuauggaugaauucauugaacgguauaaauuagaaggcuaugccuucgaacauaucguuuauggagauuuuagucauagucaguuaggugguuuacaucuacugauuggacuagcuaaacguuuuaaggaaucaccuuuugaauuagaagauuuuauuccuauggacaguacaguuaaaaacuauuucauaacagaugcgcaaacagguucaucuaaguguguguguucuguuauugauuuauuacuugaugauuuuguugaaauaauaaaaucccaagauuuaucuguaguuucuaagguugucaaagugacuauugacuauacagaaauuucauuuaugcuuugguguaaagauggccauguagaaacauuuuacccaaaauuacaaucuagucaagcguggcaaccggguguugcuaugccuaaucuuuacaaaaugcaaagaaugcuauuagaaaagugugaccuucaaaauuauggugauagugcaacauuaccuaaaggcauaaugaugaaugucgcaaaauauacucaacugugucaauauuuaaacacauuaacauuagcuguacccuauaauaugagaguuauacauuuuggugcugguucugauaaaggaguugcaccagguacagcuguuuuaagacagugguugccuacggguacgcugcuugucgauucagaucuuaaugacuuugucucugaugcagauucaacuuugauuggugauugugcaacuguacauacagcuaauaaaugggaucucauuauuagugauauguacgacccuaagacuaaaaauguuacaaaagaaaaugacucuaaagaggguuuuuucacuuacauuuguggguuuauacaacaaaagcuagcucuuggagguuccguggcuauaaagauaacagaacauucuuggaaugcugaucuuuauaagcucaugggacacuucgcaugguggacagccuuuguuacuaaugugaaugcgucaucaucugaagcauuuuuaauuggauguaauuaucuuggcaaaccacgcgaacaaauagaugguuaugucaugcaugcaaauuacauauuuuggaggaauacaaauccaauucaguugucuuccuauucuuuauuugacaugaguaaauuuccccuuaaauuaagggguacugcuguuaugucuuuaaaagaaggucaaaucaaugauaugauuuuaucucuucuuaguaaagguagacuuauaauuagagaaaacaacagaguuguuauuucuagugauguucuuguuaacaacuaaacgaacaauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuaaaaucauaugguuuctacacgacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaacgaacuuauggauuuguuuaugagaaucuucacaauuggaacuguaacuuugaagcaaggugaaaucaaggaugcuacuccuucagauuuuguucgcgcuacugcaacgauaccgauacaagccucacucccuuucggauggcuuauuguuggcguugcacuucuugcuguuuuucagagcgcuuccaaaaucauaacccucaaaaagagauggcaacuagcacucuccaaggguguucacuuuguuugcaacuugcuguuguuguuuguaacaguuuacucacaccuuuugcucguugcugcuggccuugaagccccuuuucucuaucuuuaugcuuuagucuacuucuugcagaguauaaacuuuguaagaauaauaaugaggcuuuggcuuugcuggaaaugccguuccaaaaacccauuacuuuaugaugccaacuauuuucuuugcuggcauacuaauuguuacgacuauuguauaccuuacaauaguguaacuucuucaauugucauuacuucaggugauggcacaacaaguccuauuucugaacaugacuaccagauuggugguuauacugaaaaaugggaaucuggaguaaaagacuguguuguauuacacaguuacuucacuucagacuauuaccagcuguacucaacucaauugaguacagacacugguguugaacauguuaccuucuucaucuacaauaaaauuguugaugagccugaagaacauguccaaauucacacaaucgacgguucauccggaguuguuaauccaguaauggaaccaauuuaugaugaaccgacgacgacuacuagcgugccuuuguaagcacaagcugaugaguacgaacuuauguacucauucguuucggaagagacagguacguuaauaguuaauagcguacuucuuuuucuugcuuucgugguauucuugcuaguuacacuagccauccuuacugcgcuucgauugugugcguacugcugcaauauuguuaacgugagucuuguaaaaccuucuuuuuacguuuacucucguguuaaaaaucugaauucuucuagaguuccugaucuucuggucuaaacgaacuaaauauuauauuaguuuuucuguuuggaacuuuaauuuuagccauggcagauuccaacgguacuauuaccguugaagagcuuaaaaagcuccuugaacaauggaaccuaguaauagguuuccuauuccuuacauggauuugucuucuacaauuugccuaugccaacaggaauagguuuuuguauauaauuaaguuaauuuuccucuggcuguuauggccaguaacuuuagcuuguuuugugcuugcugcuguuuacagaauaaauuggaucaccgguggaauugcuaucgcaauggcuugucuuguaggcuugauguggcucagcuacuucauugcuucuuucagacuguuugcgcguacgcguuccauguggucauucaauccagaaacuaacauucuucucaacgugccacuccauggcacuauucugaccagaccgcuucuagaaagugaacucguaaucggagcugugauccuucguggacaucuucguauugcuggacaccaucuaggacgcugugacaucaaggaccugccuaaagaaaucacuguugcuacaucacgaacgcuuucuuauuacaaauugggagcuucgcagcguguagcaggugacucagguuuugcugcauacagucgcuacaggauuggcaacuauaaauuaaacacagaccauuccaguagcagugacaauauugcuuugcuuguacaguaagugacaacagauguuucaucucguugacucucagguuacuauagcagagauauuacuaauuauuaugaggacuuuuaaaguuuccauuuggaaucuugauuacaucauaaaccucauaauuaaaaauuuaucuaagucacuaacugagaauaaauauucucaauuagaugaagagcaaccaauggagauugauuaaacgaacaugaaaauuauucuuuucuuggcacugauaacacucgcuacuugugagcuuuaucacuaccaagaguguguuagagguacaacaguacuuuuaaaagaaccuugcucuucuggaacauacgagggcaauucaccauuucauccucuagcugauaacaaauuugcacugacuugcuuuagcacucaauuugcuuuugcuuguccugacggcguaaaacacgucuaucaguuacgugccagaucaguuucaccuaaacuguucaucagacaagaggaaguucaagaacuuuacucuccaauuuuucuuauuguugcggcaauaguguuuauaacacuuugcuucacacucaaaagaaagacagaaugauugaacuuucauuaauugacuucuauuugugcuuuuuagccuuucugcuauuccuuguuuuaauuaugcuuauuaucuuuugguucucacuugaacugcaagaucauaaugaaacuugucacgccuaaacgaacaugaaauuucuuguuuucuuaggaaucaucacaacuguagcugcauuucaccaagaauguaguuuacagucauguacucaacaucaaccauauguaguugaugacccguguccuauucacuucuauucuaaaugguauauuagaguaggagcuagaaaaucagcaccuuuaauugaauugugcguggaugaggcugguucuaaaucacccauucaguacaucgauaucgguaauuauacaguuuccuguucaccuuuuacaauuaauugccaggaaccuaaauuggguagucuuguagugcguuguucguucuaugaagacuuuuuagaguaucaugacguucguguuguuuuagauuucaucuaaacgaacaaacuaaaaugucugauaauggaccccaaaaucagcgaaaugcaccccgcauuacguuugguggacccucagauucaacuggcaguaaccagaauggagaacgcaguggggcgcgaucaaaacaacgucggccccaagguuuacccaauaauacugcgucuugguucaccgcucucacucaacauggcaaggaagaccuuaaauucccucgaggacaaggcguuccaauuaacaccaauagcaguccagaugaccaaauuggcuacuaccgaagagcuaccagacgaauucgugguggugacgguaaaaugaaagaucucaguccaagaugguauuucuacuaccuaggaacugggccagaagcuggacuucccuauggugcuaacaaagacggcaucauauggguugcaacugagggagccuugaauacaccaaaagaucacauuggcacccgcaauccugcuaacaaugcugcaaucgugcuacaacuuccucaaggaacaacauugccaaaaggcuucuacgcagaagggagcagaggcggcagucaagccucuucucguuccucaucacguagucgcaacaguucaagaaauucaacuccaggcagcaguaggggaacuucuccugcuagaauggcuggcaauggcggugaugcugcucuugcuuugcugcugcuugacagauugaaccagcuugagagcaaaaugucugguaaaggccaacaacaacaaggccaaacugucacuaagaaaucugcugcugaggcuucuaagaagccucggcaaaaacguacugccacuaaagcauacaauguaacacaagcuuucggcagacgugguccagaacaaacccaaggaaauuuuggggaccaggaacuaaucagacaaggaacugauuacaaacauuggccgcaaauugcacaauuugcccccagcgcuucagcguucuucggaaugucgcgcauuggcauggaagucacaccuucgggaacgugguugaccuacacaggugccaucaaauuggaugacaaagauccaaauuucaaagaucaagucauuuugcugaauaagcauauugacgcauacaaaacauucccaccaacagagccuaaaaaggacaaaaagaagaaggcugaugaaacucaagccuuaccgcagagacagaagaaacagcaaacugugacucuucuuccugcugcagauuuggaugauuucuccaaacaauugcaacaauccaugagcagugcugacucaacucaggccuaaacucaugcagaccacacaaggcagaugggcuauauaaacguuuucgcuuuuccguuuacgauauauagucuacucuugugcagaaugaauucucguaacuacauagcacaaguagauguaguuaacuuuaaucucacauagcaaucuuuaaucaguguguaacauuagggaggacuugaaagagccaccacauuuucaccgaggccacgcggaguacgaucgaguguacagugaacaaugcuagggagagcugccuauauggaagagcccuaauguguaaaauuaauuuuaguagugcuauccccaugugauuuuaauagcuucuuaggagaaugacaaaaaaaaaaaa

SEQ ID NO: 9 - DNA, 29903 bp, Artificial Sequence
  passage 10 plaque 1
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaatatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 10 - DNA, 29903 bp, Artificial Sequence
  passage 10 plaque 2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagttatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 11 - DNA, 29903 bp, Artificial Sequence
  passage 10 plaque 3
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagctttttgtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctagaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgggcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcatcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 12 - DNA, 29903 bp, Artificial Sequence
  passage 10 plaque 4
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaatatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctagaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgggcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 13 - DNA, 30857 bp, Artificial Sequence
  SARS-CoV-2-nLUC Genbank MT461671
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaaggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaagcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 14 - DNA, 30119 bp, Artificial Sequence
  SARS-CoV-2-nLUC; Genbank MT844089
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgtaagcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaa

SEQ ID NO: 15 - DNA, 29882 bp, Artificial Sequence
  MA10; Genbank MT844088
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaa

SEQ ID NO: 16 - DNA, 29903 bp, Artificial Sequence
  10.1.1
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggcgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgttatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 17 - DNA, 29903 bp, Artificial Sequence
  MA10.1.2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggcgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgttatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcatacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 18 - DNA, 29903 bp, Artificial Sequence
  MA10.1.3
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggcgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgttatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccattttcatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactgtctatgcagaactggaaccaccttgtaggtttgttacagacacacctaaaggtcctaaagtgaagtatttgtactttattaaaggattaaacaacctaaatagaggtatggtacttggtagtttggctgccacagtgcgtctacaggctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatttctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 19 - DNA, 29903 bp, Artificial Sequence
  MA10.1.4
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggcgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgttatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattctctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 20 - DNA, 29903 bp, Artificial Sequence
  MA10.1.5
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttacctcaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtgtaatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcatttgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 21 - DNA, 29903 bp, Artificial Sequence
  MA10.2.1
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacactaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctctgctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 22 - DNA, 29903 bp, Artificial Sequence
  MA10.2.2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactatcccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 23 - DNA, 29903 bp, Artificial Sequence; identical to SEQ ID NO: 22
  MA10.2.3

SEQ ID NO: 24 - DNA, 29903 bp, Artificial Sequence
  MA10.2.4
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggcgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactatcccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 25 - DNA, 29903 bp, Artificial Sequence
  MA10.2.5
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaatatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacctaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtctagcctcttctcgttcctcatcacgtagtcgcaacagttcaagaaattcaactccaggcagcagtaggggaacttctcctgctagaatggctggcaatggcggtgatgctgctcttgctttgctgctgcttgatagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 26 - DNA, 29903 bp, Artificial Sequence; identical to SEQ ID NO: 9
  MA10.3.1

SEQ ID NO: 27 - DNA, 29903 bp, Artificial Sequence; identical to SEQ ID NO: 10
  MA10.3.2

SEQ ID NO: 28 - DNA, 29903 bp, Artificial Sequence; identical to SEQ ID NO: 11
  MA10.3.3

SEQ ID NO: 29 - DNA, 29903 bp, Artificial Sequence; identical to SEQ ID NO: 12
  MA10.3.4

SEQ ID NO: 30 - DNA, 29903 bp, Artificial Sequence; identical to SEQ ID NO: 12
  MA10

SEQ ID NO: 31 - DNA, 29903 bp, Artificial Sequence
  MA10.4.1
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagttatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttttctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 32 - DNA, 29903 bp, Artificial Sequence
  MA10.4.2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagtaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 33 - DNA, 29903 bp, Artificial Sequence; identical to SEQ ID NO: 32
  MA10.4.3

SEQ ID NO: 34 - DNA, 29903 bp, Artificial Sequence
  MA10.4.4
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttttgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttgagggccaattctgctgtcagattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatgcagaactggaaccaccttgtaggtttgttacagacacacctaaaggtcctaaagtgaagtatttatactttattaaaggattaaacaacctaaatagaggtatggtacttggtagtttggctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcacctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 35 - DNA, 29903 bp, Artificial Sequence; identical to SEQ ID NO: 32
  MA10.4.5

SEQ ID NO: 36 - DNA, 29903 bp, Artificial Sequence
  MA10.5.1
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactagtgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacacctcttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaggtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 37 - DNA, 29903 bp, Artificial Sequence
  MA10.5.2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactagtgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacacctcttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctccttggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaggtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 38 - DNA, 29903 bp, Artificial Sequence
  MA10.5.3
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactagtgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacacctcttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaggtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactctcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 39 - DNA, 29903 bp, Artificial Sequence; identical to SEQ ID NO: 36
  MA10.5.4

SEQ ID NO: 40 - DNA, 29903 bp, Artificial Sequence
  MA10.5.5
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgcccatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactagtgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacacctcttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagcacgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcatttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttaaaatcatatggtttctacacgactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaggtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 41 - DNA, 39 bp, Artificial Sequence
  primer
atatggtttctacacgactaatggtgttggttaccaacc

SEQ ID NO: 42 - DNA, 52 bp, Artificial Sequence
  primer
tagtcgtgtagaaaccatatgattgtaaaggaaagtaacaattaaaaccttc

SEQ ID NO: 43 - DNA, 20 bp, Artificial Sequence
  primer
gaccccaaaatcagcgaaat

SEQ ID NO: 44 - DNA, 24 bp, Artificial Sequence
  primer
accccgcattacgtttggtggacc

SEQ ID NO: 45 - DNA, 24 bp, Artificial Sequence
  primer
tctggttactgccagttgaatctg

SEQ ID NO: 46 - DNA, 26 bp, Artificial Sequence
  primer
gtttataccttcccaggtaacaaacc

SEQ ID NO: 47 - DNA, 24 bp, Artificial Sequence
  primer
aagaagcaatgaagtagctgagcc

SEQ ID NO: 48 - DNA, 27 bp, Artificial Sequence
  primer
gtagaaataccatcttggactgagatc

SEQ ID NO: 49 - DNA, 29 bp, Artificial Sequence
  primer
gcttctggtaatctattactagataaacg

SEQ ID NO: 50 - DNA, 26 bp, Artificial Sequence
  primer
aagacatcagcatactcctgattagg

SEQ ID NO: 51 - DNA, 27 bp, Artificial Sequence
  biotin oligomer
ggctctgttgggaatgttttgtatgcg

SEQ ID NO: 52 - DNA, 11 bp, Artificial Sequence
  restriction site
  misc_feature (7)..(11): n is a, c, g, or t
ggtctcnnnnn

SEQ ID NO: 53 - DNA, 11 bp, Artificial Sequence
  restriction site
  misc_feature (7)..(11): n is a, c, g, or t
cgtctcnnnnn

That which is claimed:

1. A recombinant SARS-CoV-2 virus particle comprising a spike protein, wherein the spike protein comprises the amino acid sequence: MFVFLVLLPLVSSQCVNLTTRTQLPPAYTNSFTRGVYYPDKVFRSSVLHSTQDLFLPFFS NVTWFHAIHVSGTNGTKRFDNPVLPFNDGVYFASTEKSNIIRGWIFGTTLDSKTQSLLIV NNATNVVIKVCEFQFCNDPFLGVYYHKNNKSWMESEFRVYSSANNCTFEYVSQPFLMD LEGKQGNFKNLREFVFKNIDGYFKIYSKHTPINLVRDLPQGFSALEPLVDLPIGINITRFQT LLALHRSYLTPGDSSSGWTAGAAAYYVGYLQPRTFLLKYNENGTITDAVDCALDPLSET KCTLKSFTVEKGIYQTSNFRVQPTESIVRFPNITNLCPFGEVFNATRFASVYAWNRKRISN CVADYSVLYNSASFSTFKCYGVSPTKLNDLCFTNVYADSFVIRGDEVRQIAPGQTGKIA DYNYKLPDDFTGCVIAWNSNNLDSKVGGNYNYLYRLFRKSNLKPFERDISTEIYQAGST PCNGVEGFNCYFPLQSYGFQPTNGVGYQPYRVVVLSFELLHAPATVCGPKKSTNLVKN KCVNFNFNGLTGTGVLTESNKKFLPFQQFGRDIADTTDAVRDPQTLEILDITPCSFGGVS VITPGTNTSNQVAVLYQDVNCTEVPVAIHADQLTPTWRVYSTGSNVFQTRAGCLIGAEH VNNSYECDIPIGAGICASYQTQTNSPRRARSVASQSIIAYTMSLGAENSVAYSNNSIAIPT NFTISVTTEILPVSMTKTSVDCTMYICGDSTECSNLLLQYGSFCTQLNRALTGIAVEQDK NTQEVFAQVKQIYKTPPIKDFGGFNFSQILPDPSKPSKRSFIEDLLFNKVTLADAGFIKQY GDCLGDIAARDLICAQKFNGLTVLPPLLTDEMIAQYTSALLAGTITSGWTFGAGAALQIP FAMQMAYRFNGIGVTQNVLYENQKLIANQFNSAIGKIQDSLSSTASALGKLQDVVNQN AQALNTLVKQLSSNFGAISSVLNDILSRLDKVEAEVQIDRLITGRLQSLQTYVTQQLIRAA EIRASANLAATKMSECVLGQSKRVDFCGKGYHLMSFPQSAPHGVVF LHVTYVPAQEKN FTTAPAICHDGKAHFPREGVFVSNGTHWFVTQRNFYEPQIITTDNTFVSGNCDVVIGIVN NTVYDPLQPELDSFKEELDKYFKNHTSPDVDLGDISGINASVVNIQKEIDRLNEVAKNLN ESLIDLQELGKYEQYIKWPWYIWLGFIAGLIAIVMVTIMLCCMTSCCSCLKGCCSCGSCC KFDEDDSEPVLKGVKLHYT (SEQ ID NO:2) or an amino acid sequence at least 90% identical thereto, wherein either said amino acid sequence comprises a substitution of Q498Y and P499T.

2. An isolated nucleic acid molecule encoding the SARS-CoV-2 virus particle of claim 1.

3. An isolated nucleic acid molecule encoding the SARS-CoV-2 virus particle of claim 1, wherein the nucleic acid molecule comprises one or more of the following nonsynonymous nucleotide substitutions, wherein the numbering is based on the reference nucleotide sequence of SEQ ID NO:1:

G9479T, C9491T, A12678G, A12884G, C23039A, C9438T, A11847G, A12159G, T27221C, C23054T, A23056C, C23057A, C23059G.

4. The isolated nucleic acid molecule of claim 3, further comprising one or more synonymous nucleotide substitution(s).

5. The isolated nucleic acid molecule of claim 4, wherein the synonymous nucleotide substitution is T15102A.

6. The isolated nucleic acid molecule of claim 3, wherein the nucleic acid molecule comprises the nucleotide sequence of SEQ ID NO:8.

7. The isolated nucleic acid molecule of claim 3, wherein the nucleic acid molecule comprises the nucleotide sequence of SEQ ID NO:9.

8. The isolated nucleic acid molecule of claim 3, wherein the nucleic acid molecule comprises the nucleotide sequence of SEQ ID NO:10.

9. The isolated nucleic acid molecule of claim 3, wherein the nucleic acid molecule comprises the nucleotide sequence of SEQ ID NO:11.

10. The isolated nucleic acid molecule of claim 3, wherein the nucleic acid molecule comprises the nucleotide sequence of SEQ ID NO:12.

11. The isolated nucleic acid molecule of claim 3, wherein the nucleic acid molecule comprises the nucleotide sequence of SEQ ID NO:15.

12. The isolated nucleic acid molecule of claim 3, wherein the nucleic acid molecule comprises the nucleotide sequence of SEQ ID NO:16, 17, 19, 20, 21, 22, 23, 24, 25, 26, 27, 28, 29, 30, 31, 32, 33, 34, 35, 36, 37, 38, 39 or 40.

13. A population of SARS-CoV-2 particles comprising the SARS-CoV-2 virus particle of claim 1.

14. A composition comprising the SARS-CoV-2 virus particle of claim 1 in a pharmaceutically acceptable carrier.

15. A composition comprising the isolated nucleic acid molecule of claim 2 in a pharmaceutically acceptable carrier.

16. A method of producing an immune response to a coronavirus in a subject, comprising administering to the subject an effective amount of the SARS-CoV-2 virus particle of claim 1.

17. The recombinant SARS-CoV-2 virus particle of claim 1, wherein the spike protein amino acid sequence further comprises the substitution Q493K.

18. The isolated nucleic acid molecule of claim 2, wherein the nucleic acid molecule comprises a nucleotide sequence of SEQ ID NO:15.

19. The isolated nucleic acid molecule of claim 2, wherein the nucleic acid molecule encodes
  a substitution of Q493K in the spike protein amino acid sequence, and further encodes
    a SARS-CoV-2 nsp4 protein comprising a T285I, G309C and/or H313Y substitution(s);
    a SARS-CoV-2 nsp7 protein comprising a K2R substitution;
    a SARS-CoV-2 nsp8 protein comprising a E23G and/or K196R substitution;
    a SARS-CoV-2 nsp9 protein comprising a T67A substitution; and/or
    a SARS-CoV-2 ORF6 protein comprising a F7S substitution,
  wherein the numbering corresponds to the amino acid sequences of SEQ ID NO:3 (nsp4 protein), SEQ ID NO:4 (nsp7 protein), SEQ ID NO:5 (nsp8 protein), SEQ ID NO:6 (nsp9 protein) or SEQ ID NO:7 (ORF6 protein), respectively.

20. The isolated nucleic acid molecule of claim 19, wherein the nucleic acid molecule further encodes
    a SARS-CoV-2 nsp4 protein comprising the amino acid sequence of SEQ ID NO:3, wherein said amino acid sequence comprises a T285I substitution;
    a SARS-CoV-2 nsp7 protein comprising the amino acid sequence of SEQ ID NO:4, wherein said amino acid sequence comprises a K2R substitution;
    a SARS-CoV-2 nsp8 protein comprising the amino acid sequence of SEQ ID NO:5, wherein said amino acid sequence comprises a E23G substitution; and
    a SARS-CoV-2 ORF6 protein comprising the amino acid sequence of SEQ ID NO:7, wherein said amino acid sequence comprises a F7S substitution.

21. The isolated nucleic acid molecule of claim 20, wherein the nucleic acid molecule comprises a nucleotide sequence selected from the group consisting of SEQ ID NO:8, 9, 10, 11, 12, 16, 17, 18, 19, 20, 21, 22, 23, 24, 25, 26, 27, 28, 29, 30, 31, 32, 33, 34, 35, 36, 37, 38, 39, and 40.

22. The isolated nucleic acid molecule of claim 20, wherein the nucleic acid molecule comprises a nucleotide sequence selected from the group consisting of SEQ ID NO:8 and SEQ ID NO:30.

\* \* \* \* \*

UNITED STATES PATENT AND TRADEMARK OFFICE
CERTIFICATE OF CORRECTION

| | |
|---|---|
| PATENT NO. | : 11,225,508 B1 |
| APPLICATION NO. | : 17/173617 |
| DATED | : January 18, 2022 |
| INVENTOR(S) | : Baric et al. |

It is certified that error appears in the above-identified patent and that said Letters Patent is hereby corrected as shown below:

In the Specification

Column 31, Lines 17-19:
Please correct "about 0.5 pg to about 15 µg, about 1 pg to about 200 µg, about 5 pg to about 250 µg, or about 2.5 pg to about 115 pg." to read -- about 0.5 µg to about 15 µg, about 1 µg to about 200 µg, about 5 µg to about 250 µg, or about 2.5 µg to about 115 µg. --

Column 45, Line 35:
Please correct "2004" to read -- 200 µL --

Column 47, Line 39:
Please correct "[MOT]" to read -- [MOI] --

Signed and Sealed this
Tenth Day of May, 2022

Katherine Kelly Vidal
*Director of the United States Patent and Trademark Office*